(12) United States Patent
Schiller et al.

(10) Patent No.: US 10,428,137 B2
(45) Date of Patent: Oct. 1, 2019

(54) PROTEIN ASSEMBLER

(71) Applicant: ALBERT-LUDWIGS-UNIVERSITÄT FREIBURG, Freiburg (DE)

(72) Inventors: Stefan Schiller, Pfaffenweiler (DE); Matthias Huber, Freiburg (DE)

(73) Assignee: ALBERT-LUDWIGS-UNIVERSITAT FREIBURG, Freiburg (DE)

( * ) Notice: Subject to any disclaimer, the term of this patent is extended or adjusted under 35 U.S.C. 154(b) by 9 days.

(21) Appl. No.: 14/404,822

(22) PCT Filed: May 28, 2013

(86) PCT No.: PCT/EP2013/060957
§ 371 (c)(1),
(2) Date: Dec. 1, 2014

(87) PCT Pub. No.: WO2013/178627
PCT Pub. Date: Dec. 5, 2013

(65) Prior Publication Data
US 2015/0126452 A1 May 7, 2015

(30) Foreign Application Priority Data
May 29, 2012 (EP) ...................... 12169717

(51) Int. Cl.
C07K 14/78 (2006.01)
C12N 15/10 (2006.01)
C12N 15/66 (2006.01)
A61K 47/64 (2017.01)

(52) U.S. Cl.
CPC .......... *C07K 14/78* (2013.01); *A61K 47/6435* (2017.08); *C12N 15/1031* (2013.01); *C12N 15/66* (2013.01)

(58) Field of Classification Search
None
See application file for complete search history.

(56) References Cited

U.S. PATENT DOCUMENTS

| 8,497,356 B2 * | 7/2013 | Chilkoti | A61K 47/60 530/350 |
| 2005/0255554 A1 * | 11/2005 | Chilkoti | C07K 14/36 435/69.1 |
| 2006/0015070 A1 | 1/2006 | Howell | |
| 2007/0009602 A1 * | 1/2007 | Setton | A61K 9/0024 424/486 |
| 2010/0015070 A1 | 1/2010 | Bollschweiler et al. | |

FOREIGN PATENT DOCUMENTS

| WO | WO 98/10063 A1 | 3/1998 | |
| WO | WO-2012111438 A1 * | 8/2012 | ........... A61L 27/227 |

OTHER PUBLICATIONS

International Search Report and Written Opinion dated Jan. 14, 2014 corresponding to International Patent Application No. PCT/EP2013/060957.
Jonathan R. McDaniel et al., "Recursive Directional Ligation by Plasmid Reconstruction Allows Rapid and Seamless Cloning of Oligomeric Genes," Biomacromolecules, vol. 11, No. 4, Apr. 2010, pp. 944-952, XP002684707.
Alessandra Girotti et al., "Elastin-Like Recombinamers: Biosynthetic Strategies and Biotechnological Applications," Biotechnology Journal, vol. 6, No. 10, Sp. Iss. SI, Oct. 2011, pp. 1174-1186, XP002684708.
Sarah R. MacEwan et al., "Elastin-Like Polypeptides: Biomedical Applications of Tunable Biopolymers," Biopolymers, vol. 94, No. 1, Jan. 1, 2010, pp. 60-77, XP055052053.
Angelo Bracalello et al., "Design and Production of a Chimeric Resilin-, Elastin-, and Collagen-Like Engineered Polypeptide," Biomacromolecules, vol. 12, No. 8, Aug. 1, 2011, pp. 2957-2965, XP002697125, American Chemical Society.
Wafa Hassouneh et al., "Fusion of Elastin-Like Polypeptides to Pharmaceutical Proteins," NIH Public Access Author Manuscript, 2012, pp. 1-24, XP002717686, retrieved from internet: http://www.ncbi.nlm.nih.gov/pmc/articles/PMC3622222/pdf/nihms-457739.pdf.
Jae H. Lee et al., "Sequential Amplification of Cloned DNA as Tandem Multimers Using Class-IIS Restriction Enzymes," Genetic Analysis: Biomolecular Engineering, vol. 13, No. 6, Dec. 1, 1996, pp. 139-145, XP004017262, Elsevier Science Publishing.
Database UniProt [Online], Jan. 11, 2007, Daniell H.: "Protein-based polymer," XP002717684, Database Accession No. AEM02934.
Database ENA [Online], Oct. 28, 2010, Ratcliffe O.J., et al., "Sequence 168 from Patent EP2046111; Plants with enhanced size and growth rate," XP002717685, Data Accession No. HI284311.

* cited by examiner

*Primary Examiner* — Nancy A Treptow
(74) *Attorney, Agent, or Firm* — Squire Patton Boggs (US) LLP

(57) ABSTRACT

The present invention relates to a method for assembling (monomeric or oligomeric) proteins and peptide structures to multimeric protein or peptide structures. The present invention also provides a method for preparing peptide based polymers by crosslinking such multimeric proteins or peptides obtainable according to the inventive method and their use as polymers, for amphiphilic applications, as protein based detergents, for forming artificial organelles, etc. Disclosed are furthermore novel protein or peptide structures, nucleic acids encoding same and cloning and expression vectors suitable for carrying out the inventive method for assembling multimeric proteins or peptides. The novel method for assembling proteins and peptide structures may be furthermore be used as a novel scalable peptide generator technique, which are also described, by preparing first a multimeric protein or peptide structure using the inventive method and then specifically degrading the multimeric protein or peptide structure into its monomeric or smaller units.

10 Claims, 21 Drawing Sheets

Figure 1:
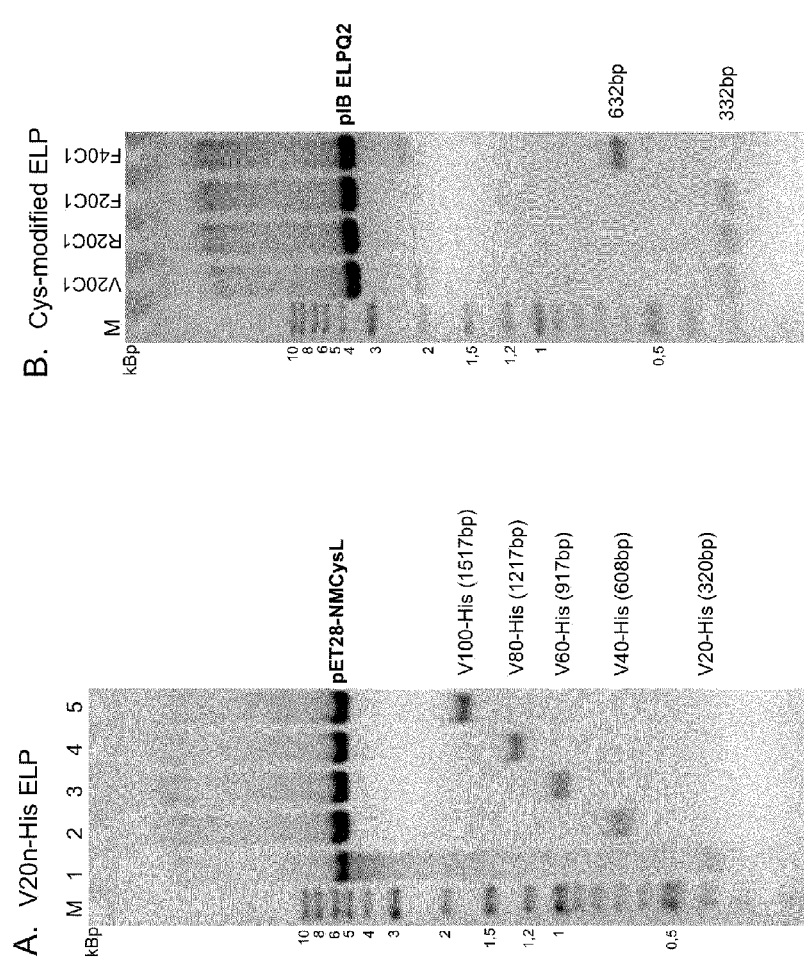

Specification includes a Sequence Listing.

Fabrication of Protein - Rubber Elastine Networks

ELP $(V_2Y)_{15}$

We use Tyr and Cys instead of Lys – not charged – Residues allow to prepare conjugated site chains on proteins

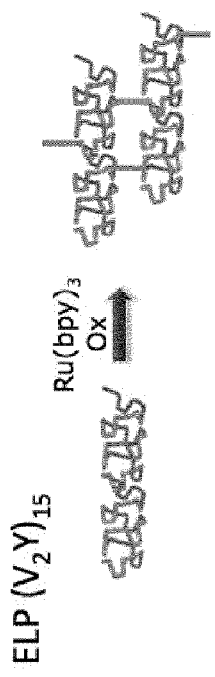

ELP $(V_2Y)_{15}$ $\xrightarrow{\text{Ru(bpy)}_3 \text{ Ox}}$ 16.5 mg ELP pro 100 microL DMSO, APS 1mM, 4 M Ru(bpy)$_3$

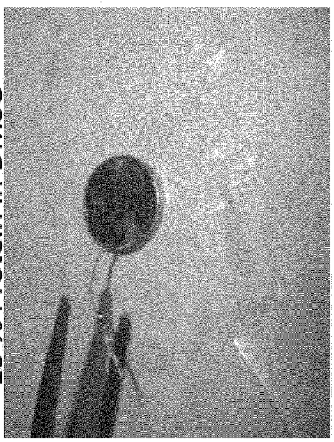

15 % Protein in DMSO

UV 366 nm

Fig. ELP with Tyr is photochemically crosslinked with Ru(bpy)$_3$ and APS in a capillary, after extraction of the catalyst the blue di-Tyr fluorescence can be observed. The small picture shows ELP $(V_2Y)_{15}$ swollen in water (left rod) and DMSO (right rod) indicating a stronger swelling in DMSO.

Figure 6

Langmuir-Blodgett-Pockels Isotherme of ELP-R20F20 from chloroform at the air/water interface Isotherme indicating the surface activity of ELP-R20F20 developing a stable film

Figure 11

PROTEIN ASSEMBLER

REFERENCE TO SEQUENCE LISTING SUBMITTED VIA EFS-WEB

This includes an electronically submitted sequence listing in .txt format. The .txt file contains a sequence listing entitled "2017-01-13 105092.00050_ST25.txt" created on Jan. 13, 2017 and is 4,486,228 bytes in size. The sequence listing contained in this .txt file is part of the specification and is hereby incorporated by reference herein in its entirety.

The present invention relates to a method for assembling (monomeric or oligomeric) proteins and peptide structures to multimeric protein or peptide structures. The present invention also provides a method for preparing peptide based polymers by crosslinking such multimeric proteins or peptides obtainable according to the inventive method and their use as polymers, for amphiphilic applications, as protein based detergents, for forming artificial organelles, etc. Disclosed are furthermore novel protein or peptide structures, nucleic acids encoding same and cloning and expression vectors suitable for carrying out the inventive method for assembling multimeric proteins or peptides. The novel method for assembling proteins and peptide structures may be furthermore be used as a novel scalable peptide generator technique, which are also described, by preparing first a multimeric protein or peptide structure using the inventive method and then specifically degrading the multimeric protein or peptide structure into its monomeric or smaller units.

Protein-based biomaterials and particularly peptide based polymers are of great interest for the biomedical field and open up a wide class of potential new applications, e.g. use as prosthesis as well as scaffolds in tissue engineering applications, as polymers in non-medical fields, etc. In recent years many efforts have been made in order to obtain such protein-based biomaterials with the aim to mimic the biological and mechanical properties of natural tissues or to develop even further potentially new polymers with unknown properties. A particular interesting class of peptide based polymers of commercial value includes inter alia elastic proteins such as elastin, resilin, elastin-like and resilin-type proteins as well as collagen and silk and their corresponding peptide based polymers. Such peptide based polymers have been the subject of intensive investigation due to their unique molecular structure and their properties.

Resilin is an elastomeric protein found in specialized regions of the cuticle of most insects, providing outstanding material properties, including high resilience and fatigue lifetime for insect flight and jumping needs (see Qin et al., Biomaterials 32 (2011) 9231-9243). In this context, resilin is an exemplary example of a natural polymer, which could be used in a multiplicity of different applications due to its surprisingly good elastic properties. As known from studies, animal movement in nature often demands both high speed and power and has to overcome the constraints imposed by the striated muscle. Arthropods overcome these limitations by slowly deforming elastic structures to maximize stored energy, and then deliver it by rapid recoil via elastomeric proteins. Such an elastomeric resilin protein is found at many joints and tendons of arthropods where fast, repeated actions, or elastic energy storage are required, such as the flight systems of locusts and beetles, the jumping mechanisms of fleas and froghoppers and the sound producing organ of cicades (see Qin et al., Biomaterials 32 (2011) 9231-9243). Recently, Elvin et al. (see Elvin et al., Nature 2005; 437(7061):999e1002) have successfully cloned and expressed the first resilin-mimetic protein from the first exon of the *Drosophila melanogaster* CG15920 gene as a soluble protein known as rec1-resilin in *Escherichia coli*. The amino acid sequence of rec1-resilin is dominated by 18 copies of a 15 residue repeat sequence GlyGlyArgProSerAspSerTyrGlyAlaProGlyGlyGlyAsn (SEQ ID NO: 92). Rec1-resilin exhibits a dual phase transition and both lower critical solution temperature (LCST) behavior and upper critical solution temperature ((UCST) behavior. LCTS is a unique temperature below which they exist in a hydrophilic, soluble state and above which they aggregate into a stiff gel-like coacervate, UCTS the corresponding upper range. The UCST was found to be pH dependent. Rec1-resilin also exhibits unique tunable photophysical properties and superior resilience when cross-linked.

Also other elastic proteins, particularly elastin, the primary elastic component of arterial blood vessels and artery walls, spider silk and their biomimetic proteins have been gained lots of interest due to their remarkable properties, when compared to synthetic polymers based on classic organochemical compounds. As reported e.g. in Truong et al., Biomaterials 31 (2010) 4434-4446 the responsive properties of elastin-mimetic proteins (EMPs) that exhibit lower critical solution temperature (LCST) have stimulated protein engineering approaches for designing materials for biology and medicine. The sol-gel transition of gelatin that exhibits responsive upper critical solution temperature (UCST) behavior has also been of significant importance in the food and pharmaceutical industries.

Particularly elastin-based biomaterials are of paramount interest for their intrinsic elastic properties as well as for their straightforward design. Elastin is characterized by the presence of small-sized repetitive sequences $(VPGVG)_n$ (SEQ ID NO: 78). As described in this context in Bracalello et al., Biomacromolecules 2011, 12, 2957-2965, there are already several approaches in the art to prepare elastin-like peptides. These approaches are mainly based on the presence of small peptides variants, for example, VPGXG (X=V, I, A) (SEQ ID NO: 93) or JGGZG (J, Z=V, L, A) (SEQ ID NO: 94). Sometimes, a little variation was introduced by the sporadic insertion of charged residues such as K, E, and Orn in order to cross-link the polypeptides. Up to now, several elastin-like biopolymers were produced and many research groups focused their attention on the development of polypeptides containing mainly the sequences $(VPGXG)_n$ (SEQ ID NO: 93), highlighting their physicochemical properties and their high self-assembling propensities.

In view of the above, preparation of such protein-based biomaterials and peptide variants is of utmost interest. Additionally, there is an urgent need in the art to provide further peptide variants with alternate properties and methods for preparing same. It is an object of the present invention to provide such protein-based biomaterials and peptide variants and alternative structures. It is a further object to provide methods, which allow to prepare conveniently and in a controllable manner peptide based multimers which in a further could be used to prepare such peptide based polymers, e.g. via crosslinking approaches and formation of random based mixes, block-copolymers, co-polymers, etc. It is also an object of the present invention to provide a method, which allows producing selectively protein structures, which can be formed to peptide based polymers, or which may be further processed.

The objects of the present invention are solved by the attached claims.

More preferably, the objects underlying the present invention are solved according to a first embodiment by a method for assembling multimeric protein or peptide structures, which advantageously allows to specifically provide multimeric peptide sequences with tailored properties upon a continued process of digestion and circular ligation of a specifically adapted expression vector. Advantageously, such a proceeding can be automated at least in part and can be used to provide multimeric peptide sequences in high yields, typically without the necessity of further purification. The present invention also advantageously allows preparing longer protein sequences with defined order of also block like elements directly via an expression vector. This allows also assembling sequences which typically cannot be cloned with conventional cloning techniques since most techniques do not allow to precisely and reproducibly transferring long inserts between the cloning and the expression vector. The current invention provides an elegant solution for such problems.

The inventive method according to the first embodiment preferably comprises the following steps:

a) Providing or preparing a circular expression vector having a first unique restriction site for a first type II S restriction enzyme and a second unique restriction site for a second type II S restriction enzyme, the first type II S restriction enzyme suitable to generate a 3 base pair 5'-overhang in the lower strand of the vector upon cleavage with the first type II S restriction enzyme, and the second type II S restriction enzyme suitable to generate a 3 base pair 5'-overhang in the upper strand of the vector upon cleavage with the second type II S restriction enzyme, wherein the 3 base pair 5'-overhang in the upper strand and the 3 base pair 5'-overhang in the lower strand of the resulting insert (and vice versa of the vector) are complementary to each other; the circular expression vector also having a third unique restriction site for a third restriction enzyme, preferably a type II restriction enzyme or a type II S restriction enzyme, located upstream to or overlapping with the recognition sequence or restriction site of the first unique restriction enzyme, the third unique restriction site being different to the first and the second unique restriction site, wherein upon cleavage with the third restriction enzyme an at least 3 or 4 base pair 5'-overhang or an at least 3 or 4 base pair 3'-overhang is generated in the upper or lower strand of the vector, preferably different from the 5'-overhang generated by the first type II S restriction enzyme (and the second type II S restriction enzyme);

b) Digesting the circular expression vector with the first type II S restriction enzyme and the second type II S restriction enzyme to create a 3 base pair 5'-overhang in the lower strand and a 3 base pair 5'-overhang in the upper strand, wherein the 3 base pair 5'-overhang in the upper strand and the 3 base pair 5'-overhang in the lower strand are complementary to each other;

c) Inserting into the digested expression vector a multiple number of the same or different double stranded nucleic acid sequences encoding a protein or peptide sequence and exhibiting a complementary 3 base pair 5'-overhang in the upper strand and a complementary 3 base pair 5'-overhang in the lower strand, preferably until equilibrium state is achieved;

d) Circular ligation of the multiple number of double stranded nucleic acid sequences into the expression vector using a ligase;

e) Optionally propagating the circular expression vector obtained according to step d);

f) Optionally sequencing the circular expression vector obtained according to step d) or e);

g) Selection of circular expression vectors obtained according to step d), e) and/or f), comprising a predetermined repeat number of double stranded nucleic acid sequences, preferably at least 5;

h) Digesting the circular expression vector selected according to step g) with the first Type II S restriction enzyme;

i) Inserting into the digested expression vector a further double stranded nucleic acid sequence encoding a protein or peptide sequence and exhibiting a complementary 3 base pair 5'-overhang in the upper strand and a complementary 3 base pair 5'-overhang in the lower strand, wherein the further double stranded nucleic acid sequence may be identical or different to the double stranded nucleic acid sequence of step c);

j) Circular ligation of the further double stranded nucleic acid sequence of step i) into the expression vector using a ligase;

k) Repeating steps h) to j) at least once;

l) Optionally expressing, isolating and/or purifying the encoded multimeric protein or peptide structure.

According to a first step a) of the inventive method for assembling multimeric protein or peptide structures a circular expression vector is provided (or prepared) having a first unique restriction site for a (unique) first type II S restriction enzyme and a second unique restriction site for a (unique) second type II S restriction enzyme, the first type II S restriction enzyme suitable to generate a 3 base pair 5'-overhang in the lower strand of the vector upon cleavage with the first type II S restriction enzyme, and the second type II S restriction enzyme suitable to generate a 3 base pair 5'-overhang in the upper strand of the vector upon cleavage with the second type II S restriction enzyme. The 3 base pair 5'-overhang in the lower strand and the 3 base pair 5'-overhang in the upper strand are preferably complementary to each other; In this context, the type II S restriction enzyme are usually cutting at a defined distance to their non-palindromic recognition sequences. The generated overhangs are asymmetric, such that ligation occurs head to tail. The 3 base pair 5'-overhang in the lower strand and the 3 base pair 5'-overhang in the upper strand are preferably complementary to each other to allow ligation of corresponding nucleic acids or religation of the vector, if desirable. Preferably, the first unique restriction site for a first type II S restriction enzyme is located upstream to the second unique restriction site for a second type II S restriction enzyme.

In the context of the present invention, a restriction site (or alternatively termed restriction recognition site) is preferably to be understood as a location on a DNA molecule containing a specific sequence of nucleotides which are recognized and cleaved by restriction enzymes, preferably as defined herein. A recognition sequence is preferably a specific sequence of nucleotides on a DNA molecule which are recognized by restriction enzymes, preferably as defined herein. The restriction site or restriction recognition site may be identical to or may be different to the recognition sequence of a restriction enzyme as defined herein.

The circular expression vector may also have a third unique restriction site for a (unique) third restriction enzyme, e.g. a type II restriction enzyme or type II S restriction enzyme, different to the first and the second unique restriction site. The third unique restriction site is preferably located upstream to or overlapping with the recognition sequence or restriction site of the first unique restriction enzyme. The third unique restriction site is preferably different to the first and the second unique restriction site. Upon cleavage with the third restriction enzyme an at least 3 or 4 base pair 5'-overhang or an at least 3 or 4 base pair 3'-overhang is generated in the upper or lower strand of the vector, e.g. a 3 or 4 base pair 5'-overhang in the upper strand of the vector, a 3 or 4 base pair 5'-overhang in the lower strand of the vector, a 3 or 4 base pair 3'-overhang in the upper strand of the vector, or a 3 or 4 base pair 3'-overhang in the lower strand of the vector, Such an overhang generated by the third restriction enzyme is preferably different from the 5'-overhang generated by the first type II S restriction enzyme and preferably also different from the 5'-overhang generated by the second type II S restriction enzyme.

The alternative 3 or 4 base pair 5'- or 3''-overhang in the upper or lower strand created upon cleavage with the third (unique) restriction enzyme is preferably generated by first cleaving the circular expression vector with the (unique) first type II S restriction enzyme and then with the type II restriction enzyme suitable to cleave the (unique) third restriction site, preferably to generate a receiving vector with incompatible overhangs. Inserts with incompatible overhangs are typically generated by first cleaving with the (unique) third restriction enzyme and then with the (unique) second type II S restriction enzyme.

According to an alternative first step a) of the inventive method for assembling multimeric protein or peptide structures a circular expression vector is provided (or prepared) having a first unique restriction site for a first type II S restriction enzyme and a second unique restriction site for a second type II S restriction enzyme, the first type II S restriction enzyme suitable to generate a 3 base pair 3'-overhang in the upper strand upon cleavage with the first type II S restriction enzyme, and the second type II S restriction enzyme suitable to generate a 3 base pair 3'-overhang in the lower strand upon cleavage with the second type II S restriction enzyme. The 3 base pair 3'-overhang in the upper strand and the 3 base pair 3'-overhang in the lower strand are preferably complementary to each other; In this context, the type II S restriction enzyme are usually cutting at a defined distance to their non-palindromic recognition sequences. The generated overhangs are asymmetric, such that ligation occurs head to tail. The 3 base pair 3'-overhang in the upper strand and the 3 base pair 3'-overhang in the lower strand are preferably complementary to each other to allow ligation of corresponding nucleic acids or religation of the vector, if desirable. Preferably, the first unique restriction site for a first type II S restriction enzyme is then also located upstream to the second unique restriction site for a second type II S restriction enzyme.

According to this alternative first step a) the circular expression vector may also have a third unique restriction site for a (unique) third restriction enzyme preferably as defined above, e.g. a type II restriction enzyme or type II S restriction enzyme, different to the first and the second unique restriction site. The third unique restriction site is preferably located upstream to or overlapping with the recognition sequence or restriction site of the first unique restriction enzyme. The third unique restriction site is preferably different to the first and the second unique restriction site. Upon cleavage with the third restriction enzyme an at least 3 or 4 base pair 5'-overhang or an at least 3 or 4 base pair 3'-overhang is generated in the upper or lower strand of the vector, e.g. a 3 or 4 base pair 5'-overhang in the upper strand of the vector, a 3 or 4 base pair 5'-overhang in the lower strand of the vector, a 3 or 4 base pair 3'-overhang in the upper strand of the vector, or a 3 or 4 base pair 3'-overhang in the lower strand of the vector, Such an overhang generated by the third restriction enzyme is preferably different from the 3'-overhang generated by the first type II S restriction enzyme and preferably also different from the 3'-overhang generated by the second type II S restriction enzyme.

The alternative 3 or 4 base pair 5'- or 3''-overhang in the upper or lower strand created upon cleavage with the third (unique) restriction enzyme is also here preferably generated by first cleaving the circular expression vector with the (unique) first type II S restriction enzyme and then with the type II restriction enzyme suitable to cleave the (unique) third restriction site, preferably to generate a receiving vector with incompatible overhangs. Inserts with incompatible overhangs are typically generated by first cleaving with the (unique) third restriction enzyme and then with the (unique) second type II S restriction enzyme.

In the context of the present invention a circular expression vector as used herein is preferably a genetic element which can be introduced into a host organism and enables a desired nucleotide sequence to be expressed, particularly the assembled multimeric proteins or peptides, which are typically inserted into the multiple cloning site of such an expression vector. Particular examples of suitable expression vectors are plasmids, phages or viruses. Expression vectors preferably comprise "expression control sequences" or "regulatory sequences", the corresponding coding nucleotide sequence, and elements enabling the vector to be multiplied. The term "expression control sequence" or "regulatory sequence" typically comprises promoters, enhancers, transcription initiators and transcription terminators and other control elements which regulate expression of a gene, particularly the assembled multimeric proteins or peptides, which are typically inserted into the multiple cloning site of such an expression vector. According to particular aspects of the first embodiment invention, the expression control sequences can be regulated. The exact structure of regulatory sequences may vary as a function of the species or cell type, but generally comprises 5' untranscribed and 5' untranslated sequences which are involved in initiation of transcription and translation, respectively, such as TATA box, capping sequence, CAAT sequence, and the like. More specifically, 5' untranscribed regulatory sequences comprise a promoter region which includes a promoter sequence for transcriptional control of the functionally linked gene. Regulatory sequences may also comprise enhancer sequences or upstream activator sequences.

The inventive expression vectors are preferably circular expression vectors and may be digested and ligated again to circular expression vectors throughout the inventive method. Expression systems, from which such a (circular) expression vector may be derived or which may be used to propagate such an inventive expression vector are well known and have been described in e.g. Sambrook et al.: Molecular cloning: A Laboratory Manual; $3^{rd}$ Ed. Cold Spring Harbour Laboratory Press; Cold Spring Harbour (2001). Suitable expression systems and (circular) expression vectors may be selected from, without being limited thereto, prokaryotic expression systems, eukaryotic expression systems, etc. Non-limiting examples of prokaryotic expression organisms are, without being limited thereto, *Escherichia coli, Bacillus subtilis, Bacillus megaterium, Corynebacterium glutamicum*, and others. Nonlimiting examples of eukaryotic expression organisms are yeasts such as *Saccharomyces cerevisiae, Pichia pastoris*, and others, filamentose fungi such as *Aspergillus niger, Aspergillus oryzae, Aspergillus nidulans, Trichoderma reesei, Acremonium chrysogenum*, and others, mammalian cells such as HeLa-cells, COS cells, CHO cells, dendritic cells, B cells, K562 cells, and others, insect cells such as Sf9 cells, MEL cells, and others, plants or plant cells such as *Solanum tuberosum, Nicotiana, Physcomitrella paten*, and others. Non-limiting examples of archaea/extremophilic expression organisms are, without being limited thereto, *Methanococcus* species, e.g *Methanococcus jannaschii, Methanosarcina acetivorans, Sulfolobus solfataricus, Methanococcus mazei* and others.

Alternatively, synthetic expression vectors may be used. Such synthetic expression vectors may be selected from vectors of the pET expression system, e.g pET28b(+) (Novagene), pIB-vectors (Invitrogene), pGEX vectors (GE-lifescience) etc. Such synthetic expression vectors may be propagated in one of the herein defined expression systems or any further suitable expression system.

According to a further alternative, cloning vectors may be used in step a) instead of expression vectors and the generated multimeric peptide sequences may then be cloned into an expression system or vector, preferably as defined herein. Suitable cloning vectors may be selected e.g. from cloning vectors such as pIB-HisC vector (Invitrogene), pIB-HisC based vectors pIB-ELPQ2 and pIB-ELPL (obtainable by removing intrinsic EarI/BspQI sites from commercially available vector pIBHisC and inserting specific linker regions ELPL or ELPQ2 for multimerisation of template units), etc. Apart from cloning in *E. coli* cloning and expression vectors as pET28-NMCysL, pIB-NMCysL (derived from pIB-ELPQ and pIB-ELPL), pIB-ELPQ and pIB-ELPL also allow direct expression in insect cells (lepidoptera). Furthermore, the pMAV vector for expression in arabidopsis or physcomitrella may be used. Multimerisation using cloning vectors then occurs as described for the inventive method for assembling multimeric protein or peptide structures as outlined herein by using cloning vectors in step a) instead of expression vectors. Then, an additional step may be included preferably prior to optionally expressing, isolating and/or purifying the encoded protein or peptide according to step 1). Such an additional step preferably comprises digestion of the cloning vector with the first and the second type II S restriction enzymes as defined herein, isolation of the insert, transferring the insert into the correspondingly digested expression vector, and circular ligation of the expression vector and the insert. Methods for expressing, isolating and/or purifying are known to a skilled person and may be found e.g. in Sambrook et al.: Molecular cloning: A Laboratory Manual; 3' Ed. Cold Spring Harbour Laboratory Press; Cold Spring Harbour (2001), Any of the herein described vectors, either expression vectors or cloning vectors, is preferably modified prior to use to exhibit a first unique restriction site for a first type II S restriction enzyme as defined herein and a second unique restriction site for a second type II S restriction enzyme as defined herein as well as a third unique restriction site for a (unique) third restriction enzyme described above.

Preferred systems generally suitable for propagating or expressing a vector as described above, i.e. an expression vector or a cloning vector as described herein, are well known and have been described in e.g. Sambrook et al.: Molecular cloning: A Laboratory Manual; 3$^{rd}$ Ed. Cold Spring Harbour Laboratory Press; Cold Spring Harbour (2001). Particularly preferred systems suitable for propagating or expressing a vector as described above may be selected from e.g. suitable cells or expression systems as described before.

According to step a) of the inventive method a first type II S restriction enzyme and a second type II S restriction enzyme are used wherein these type II S restriction enzymes are preferably suitable to generate a 3 base pair 5'-overhang in the lower strand and a 3 base pair 5'-overhang in the upper strand of the vector upon cleavage. Preferably, the 3 base pair 5'-overhang in the upper strand and the 3 base pair 5'-overhang in the lower strand are complementary to each other. Alternatively, a first type II S restriction enzyme and a second type II S restriction enzyme may be used wherein these type II S restriction enzymes are preferably suitable to generate a 3 base pair 3'-overhang in the upper strand and a 3 base pair 3'-overhang in the lower strand of the vector upon cleavage. Again, the 3 base pair 3'-overhang in the upper strand and the 3 base pair 3'-overhang in the lower strand are preferably complementary to each other. Type II S restriction enzymes cleave within or at short specific distances from recognition sequence; most type II S restriction enzymes require magnesium; and represent single function (restriction) enzymes independent of methylase. Hence, for the purposes of the present invention, type II S restriction enzymes are preferably selected such that cleavage occurs with a distance to the recognition sequence. Preferably, the recognition sequence is not positioned in the insert region, i.e. the region into which the herein defined double stranded nucleic acid sequence is to be inserted.

According to a step b) of the inventive method the circular expression vector is preferably digested with the first type II S restriction enzyme and the second type II S restriction enzyme. Digestion preferably leads to a 3 base pair 5'-overhang in the lower strand and a 3 base pair 5'-overhang in the upper strand. The 3 base pair 5'-overhang in the upper strand and the 3 base pair 5'-overhang in the lower strand are typically complementary to each other. Alternatively, digestion may lead to a 3 base pair 3'-overhang in the upper strand and a 3 base pair 3'-overhang in the lower strand. The 3 base pair 3'-overhang in the upper strand and the 3 base pair 3'-overhang in the lower strand are typically complementary to each other.

Preferably, digestion with the first type II S restriction enzyme and the second type II S restriction enzyme as defined herein generates a 3 bp overhanging sequence in the vector, wherein the first type II S restriction enzyme and the second type II S restriction enzyme preferably create in the digested vector the sequence ACC as a 3 base pair 5'-overhang in the lower strand and the sequence GGT as a 3 base pair 5'-overhang in the upper strand and preferably similarly create in the created insert the sequence GGT as a 3 base pair 5'-overhang in the upper strand and the sequence ACC as a 3 base pair 5'-overhang in the lower strand. The sequences defined herein are preferably read in 5'- to 3'-direction.

The cleaved region of the digested vector thus may be depicted exemplarily as follows:

wherein n is any number and N is any nucleic acid.

The insert may be depicted exemplarily as follows:

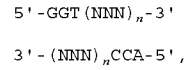

wherein n is any number and N is any nucleic acid.

According to a preferred aspect of the present invention, the type II S restriction enzymes and their restriction sites are selected from the group comprising or consisting of BspQI, EarI, SapI, Bst6I, Eam1104I, Ksp632I, LgiI, or PciSI. Even more preferably, the type II S restriction enzymes are selected from group consisting of BspQI and EarI. Most preferably, the first type II S restriction enzyme is selected from BspQI and the second type II S restriction enzyme is selected from EarI, or vice versa.

A further preferred aspect of the present invention is the interference of the restriction site of a third unique restriction enzyme with the recognition sequence of the first unique type II S restriction enzyme to generate incompatible overhangs. This prevents the re-circularization of long inserts. According to this, the third unique restriction enzymes, e.g. a type II or type II S restriction enzyme, and their restriction sites may be selected from any suitable type II or type II S restriction enzymes, such as e.g. SacI (type II restriction enzyme) or e.g. BsmAI, BsmBI or BsaI (type II S restriction enzymes).

Digestion of the expression vector with the type II S restriction enzyme(s) according to step b) may be carried out by methods well known to a skilled person (see e.g. Sambrook et al.: Molecular cloning: A Laboratory Manual; 3$^{rd}$ Ed. Cold Spring Harbour Laboratory Press; Cold Spring Harbour (2001)). Such methods may comprise e.g. adding to the expression vector the type II S restriction enzyme(s), buffer, preferably a buffer recommended by the manufacturer of the type II S restriction enzyme(s), optionally water, and optionally further ingredients, such as acetylated BSA, etc. The components are preferably mixed and incubated at an appropriate temperature, preferably between 30 and 50° C., typically about 37° C., e.g. for 10 minutes to 10 hours, e.g. 2 to 4 hours. The type II S restriction enzyme(s) may be optionally deactivated as described by the manufacturer of the components.

Upon digesting the expression vector according to step b) of the inventive method, the digested expression vector may be typically dephosphorylated, preferably using an alkaline phosphatase, e.g. calf intestine phophatase (CIP) or any further suitable phophatase. The digested expression vector may be purified and preferably isolated for further use.

According to a further step c) of the inventive method the digested expression vector is used to insert a multiple number of double stranded nucleic acid sequences, preferably exhibiting a complementary 3 base pair 5'-overhang in the upper strand and a complementary 3 base pair 5'-overhang in the lower strand until saturation is achieved. Alternatively, a multiple number of double stranded nucleic acid sequences may be inserted, preferably exhibiting a complementary 3 base pair 3'-overhang in the upper strand and a complementary 3 base pair 3'-overhang in the lower strand until saturation is achieved. In the context of the present invention, inserting a "multiple number" of double stranded nucleic acid sequences preferably means inserting (per vector used) at least 2 double stranded nucleic acid sequences as defined herein, preferably about 2 to 100, more preferably about 2 to 60, even more preferably about 2 and 40, even more preferably about 2 and 20, about 2 and 10 or even about 2 and 7, e.g. about 5, 10, 15, 20, 25, etc., such as about 2, 3, 4, 5, 6, 7, 8, 9, 10, 11, 12, 13, 14, 15, 16, 17, 18, 19, 20, 21, 22, 23, 24, 25, etc. The multiple number of double stranded nucleic acid sequences may be selected from the same or different double stranded nucleic acid sequences as defined herein. If different double stranded nucleic acid sequences are used, these are preferably provided as a mix. "Different" preferably means at least 2, 3, 4, 5, 6, 7, 8, 9, 10 or more different double stranded nucleic acid sequences as defined herein.

Ligated inserts could be derived as said from a corresponding digest of a vector as described herein, e.g. an expression vector or a cloning vector, e.g. the same vector as the target vector provided or prepared in step a) or from another vector with other integral sequences processed the same way as described herein or prepared else wise but exhibit vector compatible overhangs.

In the context of the present invention a "complementary 3 base pair 5'-overhang in the upper strand and a complementary 3 base pair 5'-overhang in the lower strand" with regard to double stranded nucleic acid sequences as defined herein typically means, that the overhang is complementary with the corresponding overlap in the vector, preferably the expression or cloning vector as described herein. As described above, restriction of the vector with the first type II S restriction enzyme and the second type II S restriction enzyme as defined herein generates a 3 bp overhanging sequence in the vector in each the upper and the lower strand. The first type II S restriction enzyme thereby preferably create as a 3 base pair 5'-overhang in the lower strand of the vector the sequence ACC (read from 5' to 3') and the second type II S restriction enzyme create a 3 base pair 5'-overhang in the upper strand of the vector with the sequence GGT (read from 5' to 3'). Accordingly, the "complementary 3 base pair 5'-overhang in the lower strand and a complementary 3 base pair 5'-overhang in the upper strand" in the double stranded nucleic acid sequences as defined herein typically means that a 3 base pair 5'-overhang is created in the lower strand having the sequence ACC and a 3 base pair 5'-overhang is created in the upper strand having the sequence GGT. This can similarly applied to 3 base pair 3'-overhangs generated alternatively. Any such ends generated in the expression or cloning vector as described herein and the double stranded nucleic acid sequence as defined herein are termed "sticky ends".

According to a particularly preferred aspect of the first embodiment a multiple number of double stranded nucleic acid sequences is inserted into the digested vector. For this purpose, the double stranded nucleic acid sequence as defined herein is typically added in excess to the digested vector, preferably in a molar ratio of at least 2:1, more preferably in a molar ratio of at least 5:1, more preferably in a molar ratio of at least 10:1 or even 20:1 double stranded nucleic acid sequence to digested vector or even more, e.g. in a molar ratio of about 2:1 to about 20:1, in a molar ratio of about 5:1 to about 20:1, in a molar ratio of about 10:1 to about 20:1, or even in a molar ratio of about 10:1 to about 50:1, etc.

Addition of the multiple number of double stranded nucleic acid sequences to the digested expression or cloning vector typically leads to assemblage of the double stranded nucleic acid sequences into the expression or cloning vector, wherein the sticky ends of the expression or cloning vector as described herein and of the double stranded nucleic acid sequence as defined herein typically adhere to each other. Additionally the sticky ends of the double stranded nucleic acid sequence as defined herein may also adhere to each other such that typically due to equilibrium reactions, a number of about 2 to about 30 double stranded nucleic acid sequence may be inserted in into the expression or cloning vector, thus forming a multiple number of repeats of the double stranded nucleic acid sequence in the expression or cloning vector. Since this insertion is driven by due to equilibrity reactions the insertion typically can be carried out by incubating the double stranded nucleic acid sequences and the digested expression or cloning vector for a time sufficient to establish an equilibrium. Hence, achieving the equilibrium state typically means the point of reaction, at which, according to the applied reaction conditions, an average or maximum number of repetitions of the double stranded nucleic acid sequence as defined herein in the vector is obtained which is preferably about 1 or 2 to 100, more preferably about 2 to 60, even more preferably about 2 and 40, even more preferably about 2 and 20, about 2 and 10 or even about 2 and 7, e.g. about 5, 10, 15, 20, 25, etc., such as about 2, 3, 4, 5, 6, 7, 8, 9, 10, 11, 12, 13, 14, 15, 16, 17, 18, 19, 20, 21, 22, 23, 24, 25, etc.

The double stranded nucleic acid sequence may encode a protein or peptide as defined herein. Such a protein or peptide may be generally any protein or peptide, which may be suitable or accessible for multimerization. Preferably, such a protein or peptide sequence exhibits a sequence of about 4 to 200 amino acids, more preferably about 4 to 50 amino acids, even more preferably 4 to 30 amino acids.

According to a preferred aspect of the inventive method, the double stranded nucleic acid sequence encodes a protein, wherein the protein is an ELP-like protein sequence according to the following general formula (I):

$$[(VZ_1PZ_2GX_1G)_n(VZ_3PZ_4GX_2G)_m]_p \qquad \text{(SEQ ID NO: 95)}$$

wherein:
V is Val
P is Pro;
G is Gly;
$X_1$ is Glu, Asp, Arg, Val, Lys, His, Ser, Thr, Asn or Gln; or is a non-naturally occurring amino acid, or is a mixture thereof;
$X_2$ is Tyr, Cys, Phe, Ile, Leu, Met, Val or Trp, or is a non-naturally occurring amino acid, or is a mixture thereof;
$Z_1$ to $Z_4$ is present or is not present and is independently from each other selected from Ala or Gly;
n+m≥1
n is an integer selected from 0 or 1 to 300;
m is an integer selected from 0 or 1 to 300;
p is an integer selected from 1 to 300.

According to a further preferred aspect of the inventive method, the double stranded nucleic acid sequence encodes a protein, wherein the ELP-like protein sequence is a resilintype ELP-like protein sequence according to the following general formula (Ia):

$$[(VPGVG)_n(VPGX_2G)_m]_p \qquad \text{(SEQ ID NO: 96)}$$

wherein:
V is Val
P is Pro;
G is Gly;
V is Val
$X_2$ is Tyr, Cys or Trp;
n is an integer selected from 0 or 1 to 300, preferably 0 or 1 to 25;
m is an integer selected from 1 to 300, preferably 1 to 100;
p is an integer selected from 1 to 300, preferably 3 to 300;

According to one particularly preferred aspect of the inventive method, the double stranded nucleic acid sequence encodes a protein, wherein the ELP-like protein sequence is a resilintype ELP-like protein sequence according to any of the following formulae:

| | |
|---|---|
| $[(VPGVG)_{0-25}(VPGYG)_{1-100}]_{3-300}$ | (SEQ ID NO: 97) |
| $[(VPGVG)_{1-10}(VPGYG)_{1-5}]_{3-200}$ | (SEQ ID NO: 98) |
| $[(VPGVG)_{1-10}(VPGYG)_1]_{3-200}$ | (SEQ ID NO: 99) |
| $[(VPGVG)_{1-5}(VPGYG)_1]_{3-200}$ | (SEQ ID NO: 100) |
| $[(VPGVG)_2(VPGYG)_1]_{3-200}$ | (SEQ ID NO: 101) |
| $[(VPGVG)_2(VPGYG)_1]_{10-100}$ | (SEQ ID NO: 102) |
| $[(VPGVG)_2(VPGYG)_1]_{10-50}$ | (SEQ ID NO: 103) |
| $[(VPGVG)_2(VPGYG)_1]_{15}$ | (SEQ ID NO: 104) |
| $[(VPGVG)_{0-25}(VPGCG)_{1-100}]_{3-300}$ | (SEQ ID NO: 105) |
| $[(VPGVG)_{1-10}(VPGCG)_{1-5}]_{3-200}$ | (SEQ ID NO: 106) |
| $[(VPGVG)_{1-10}(VPGCG)_1]_{3-200}$ | (SEQ ID NO: 107) |
| $[(VPGVG)_{1-5}(VPGCG)_1]_{3-200}$ | (SEQ ID NO: 108) |
| $[(VPGVG)_2(VPGCG)_1]_{3-200}$ | (SEQ ID NO: 109) |
| $[(VPGVG)_2(VPGCG)_1]_{10-100}$ | (SEQ ID NO: 110) |
| $[(VPGVG)_2(VPGCG)_1]_{10-50}$ | (SEQ ID NO: 111), or |
| $[(VPGVG)_2(VPGCG)_1]_{15}$ | (SEQ ID NO: 112). |

According to another preferred aspect of the inventive method, the double stranded nucleic acid sequence encodes a protein, wherein the ELP-like protein sequence is an amphiphilic ELP-like protein sequence according to the following general formula (Ib):

$$[(VZ_1PZ_2GX_1G)_n(VZ_3PZ_4GX_2G)_m]_p \qquad \text{(SEQ ID NO: 95)}$$

or according to following general formula (Ic):

$$[(VPGX_1G)_n(VPGX_2G)_m]_p \qquad \text{(SEQ ID NO: 113)}$$

or according to following general formula (Id):

$$[Y_q(VPGX_1G)_nY_q(VPGX_2G)_mY_q]_p \qquad \text{(SEQ ID NO: 114)}$$

wherein (in Ib or Ic or Id):
V is Val
P is Pro;
G is Gly;
$X_1$ is Glu, Asp, Arg, Val, Lys, His, Ser, Thr, Asn or Gln, or is a non-naturally occurring amino acid, or is a mixture thereof;
$X_2$ is Tyr, Cys, Phe, Ile, Leu, Met, Val or Trp, or is a non-naturally occurring amino acid, or is a mixture thereof;
wherein $X_1$ and $X_2$ are preferably interchanged in the general formulae in Ib or Ic or Id
Y is GFP (green fluorescent protein), mEGFP (monomeric enhanced GFP), EYFP (enhanced yellow fluorescent protein), ECFP (enhanced cyan fluorescent protein) or any further suitable fluorescent proteins or derivative thereof
$Z_1$ to $Z_4$ is present or is not present and is independently from each other selected from Ala or Gly;
n is an integer selected from 1 to 300;
m is an integer selected from 1 to 300;
p is an integer selected from 1 to 300;
q is an integer of 0 or 1

According to a particularly preferred aspect of the inventive method, the double stranded nucleic acid sequence encodes an amphiphilic ELP-like protein sequence according to one of the following formulae:

| | |
|---|---|
| $[(VPGXG)_{0-300}(VPGX_2G)_{0-300}]_{1-300}$ | (SEQ ID NO: 115) |
| $[(VPGX_1G)_{0-200}(VPGX_2G)_{0-200}]_{1-200}$ | (SEQ ID NO: 116) |
| $[(VPGX_1G)_{0-100}(VPGX_2G)_{0-100}]_{1-100}$ | (SEQ ID NO: 117) |
| $[(VPGX_1G)_{2-100}(VPGX_2G)_{2-100}]_{1-50}$ | (SEQ ID NO: 118) |

[(VPGX₁G)₅₋₁₀₀(VPGX₂G)₅₋₁₀₀]₁   (SEQ ID NO: 119)

[(VPGX₁G)₁₀₋₅₀(VPGX₂G)₁₀₋₅₀]₁   (SEQ ID NO: 120)

wherein:
V is Val
P is Pro;
G is Gly;
X₁ is Glu, Asp, Arg, Lys (His, Ser, Thr, Asn, Gln) or a mixture thereof;
X₂ is Phe, Ile, Leu, Val (Tyr, Trp, Met) or a mixture thereof,
(In any of the above ranges the integer "0" may be replaced independently by any of the integers 1, 2 or 3).

According to a further particularly preferred aspect of the inventive method, the double stranded nucleic acid sequence encodes an amphiphilic ELP-like protein sequence according to one of the following formulae:

[Y_q(VPGX₁G)₀₋₃₀₀Y_q(VPGX₂G)₀₋₃₀₀Y_q]₁₋₃₀₀   (SEQ ID NO: 121)

[Y_q(VPGX₁G)₀₋₂₀₀Y_q(VPGX₂G)₀₋₂₀₀Y_q]₁₋₂₀₀   (SEQ ID NO: 122)

[Y_q(VPGX₁G)₀₋₁₀₀Y_q(VPGX₂G)₀₋₁₀₀Y_q]₁₋₁₀₀   (SEQ ID NO: 123)

[Y_q(VPGX₁G)₂₋₁₀₀Y_q(VPGX₂G)₂₋₁₀₀Y_q]₁₋₅₀   (SEQ ID NO: 124)

[Y_q(VPGX₁G)₅₋₁₀₀Y_q(VPGX₂G)₅₋₁₀₀Y_q]₁   (SEQ ID NO: 125),

[Y_q(VPGX₁G)₁₀₋₅₀Y_q(VPGX₂G)₁₀₋₅₀Y_q]₁   (SEQ ID NO: 126)

wherein:
V is Val
P is Pro;
G is Gly;
X₁ is Glu, Asp, Arg, (Lys, Asn, Gln, Ser, Thr, His) or is a mixture thereof;
X₂ is Phe, Ile, Leu, (Tyr, Trp, Meth, Val) or is a mixture thereof,
Y is GFP, EGFP, mEGFP, EYFP, ECFP or any other appropriate proteins or mixtures of them
q is an integer of 0 or 1

According to a further alternative aspect of the inventive method, the double stranded nucleic acid sequence is selected from a nucleic acid sequence comprising or consisting of a nucleic acid sequence encoding a peptide drug, a growth factor, an epitope, an antigen, e.g. for vaccine production, an epitope of an antigens, or any further protein or peptide.

According to a further alternative aspect of the inventive method, the double stranded nucleic acid sequence is selected from a nucleic acid sequence comprising or consisting of a nucleic acid sequence according to any of the sequences defined herein, particularly SEQ ID NOs: 1, 3, 5, 7, 9, 11, 13, 15, 17, 19, 21, 23, 25, 27, 29, 31, 33, 35, 37, 39, 41, 90 or 91, or encodes a protein comprising or consisting of an amino acid sequence according to any of the sequences defined herein, particularly SEQ ID NOs: 2, 4, 6, 8, 10, 12, 14, 16, 18, 20, 22, 24, 26, 28, 30, 32, 34, 36, 38, 40, 42 to 77 or 80 to 89, or a double stranded nucleic acid sequence comprising an identity of at least about 80%, at least about 85%, at least about 90%, at least about 95%, at least about 96%, at least about 97%, at least about 98 or even %, at least about 99% to a nucleic acid sequence according to any of SEQ ID NOs: 1, 3, 5, 7, 9, 11, 13, 15, 17, 19, 21, 23, 25, 27, 29, 31, 33, 35, 37, 39, 41, 90 or 91, or a protein comprising an identity of at least about 80%, at least about 85%, at least about 90%, at least about 95%, at least about 96%, at least about 97%, at least about 98 or even %, at least about 99% to a protein according to any of SEQ ID NO: 2, 4, 6, 8, 10, 12, 14, 16, 18, 20, 22, 24, 26, 28, 30, 32, 34, 36, 38, 40, 42 to 77 or 80 to 89, (see also Annex).

The double stranded nucleic acid sequence may be furthermore selected from a nucleic acid sequence comprising or consisting of a nucleic acid sequence encoding the alpha1 chain: AASIKVAVSADR sequence (A-208) from laminin (SEQ ID NO: 43); a nucleic acid sequence encoding the protein sequence CSRARKQAASIKVAVSADR from laminin (SEQ ID NO: 44); a nucleic acid sequence encoding the protein sequence GEEIQIGHIPREDVDYHLYP (CS5 sequence; FNIII-V(variable) region) (SEQ ID NO: 45); TAQQTTKL--KLDAPT-N-LQFVNETDS (KLAPT-adhesion sequence of a fibronectin sequence as published in J. Biol. Chem 1997 Oct. 3; 272(40) (SEQ ID NOs: 46); a nucleic acid sequence encoding the protein sequence ITVYAVTGRGDSPASSKPISI from FNIII 10 (SEQ ID NO: 47); a nucleic acid sequence encoding the protein sequence from collagen: GVKGDKGNPGWPGAP (SEQ ID NO: 48); a nucleic acid sequence encoding the Neurite Outgrowth-Promoting Motif from Human Tenascin-C: VFDNFVLK (SEQ ID NO: 49); encoding the C3 peptide, which induces neurite outgrowth via FGFR—sequence and comprises the sequence: ASKKPKRNIKA (SEQ ID NO: 50); a nucleic acid sequence encoding the Neural Cell Adhesion Molecule NCAM which comprises the protein sequence NLIKQD-DGGSPIRHY (SEQ ID NO: 51); a nucleic acid sequence encoding the FGL-peptide EVYVVAENQQGKSKA (SEQ ID NO: 52); a nucleic acid sequence encoding the peptide Motif from the Second Fibronectin Module of the Neural Cell Adhesion Molecule NCAM according to the sequence NLIKQDDGGSPIRHY (SEQ ID NO: 53); a nucleic acid sequence encoding NCAM-derived peptides function as agonists for the fibroblast growth factor receptor and comprising the sequence TIMGLKPETRYAVR (SEQ ID NO: 54); a nucleic acid sequence encoding the sequence GEFYFDLRLKGDK of peptide Hep III; HIV Therapeutikum T20 from Roche (SEQ ID NO: 55); or a nucleic acid sequence encoding the sequence Cilengitide von Merck-Serono preferably represented by the (cyclic) pentapeptide sequence cyclo-[RGDfN(Me)V]) (SEQ ID NO: 56), for the purposes of the present invention preferably provided as [RGDfN(Me)V] (SEQ ID NO: 56) or [RGDNV] (SEQ ID NO: 57)), or the double stranded nucleic acid sequence may be selected from a nucleic acid sequence comprising or consisting of a nucleic acid sequence comprising an identity of at least about 80%, at least about 85%, at least about 90%, at least about 95%, at least about 96%, at least about 97%, at least about 98 or even %, at least about 99% to one of the for mentioned nucleic acid sequences or may encode a protein comprising an identity of at least about 80%, at least about 85%, at least about 90%, at least about 95%, at least about 96%, at least about 97%, at least about 98 or even %, at least about 99% to a protein according to any of SEQ ID NOs: 43 to 57.

The double stranded nucleic acid sequence may be furthermore selected from a nucleic acid sequence comprising or consisting of a nucleic acid sequence encoding the protein sequence GCGGNSEPRGDTYRAYN, termed (RGDser-NG10)_l (SEQ ID NO: 58), the protein sequence CGGNGEPRGDTYRAYIEGR, termed (RGD-IEGR10)_l (SEQ ID NO: 59), the protein sequence CGGNGEPRGD-TYRAYLVPR, termed (RGD-LVPR)_l (SEQ ID NO: 60), the protein sequence GCGNGEPRGDTYRAYENLYFQ, termed (RGD-TEV)_l (SEQ ID NO: 61), the protein sequence GCGGGEEIQIGHIPREDVDYHLYPN, termed (fibroCS5-NG10)_l (SEQ ID NO: 62), the protein sequence GCG-GEVYVVAENQQGKSKAN, termed (NCAM-FGL- NG10)$_i$ (SEQ ID NO: 63), the protein sequence GCGGTIMGLKPETRYAVRENLYFQ, termed (NCAM-encam-TEV10)$_i$ (SEQ ID NO: 64), the protein sequence GFDFDFDFDN, termed (FDFDFDFD-NG5)$_1$ (SEQ ID NO: 65), the protein sequence GAYSSGAPPMPPFN, termed (GoSi-NG5)$_i$ (SEQ ID NO: 66), or the protein sequence GLSTVQTISPSNHN, termed (IronOx-NG5)$_i$(SEQ ID NO: 67), or encoding a protein sequence comprising an identity of at least about 80%, at least about 85%, at least about 90%, at least about 95%, at least about 96%, at least about 97%, at least about 98 or even %, at least about 99% to a protein according to any of SEQ ID NOs: 58 to 67.

The double stranded nucleic acid sequence may be furthermore selected from a nucleic acid sequence comprising or consisting of a nucleic acid sequence encoding the protein sequence VHPSSSGCGGNSEPRGDTYRAYNGCGGNSEPRGDTYRAYNGCGGNSEPRGDTYRAYN GCGGNSEPRGDTYRAYNGCGGNSEPRGDTYRAYNGCGGNSEPRGDTYRAYNGCGGNS EPRGDTYRAYNGCGGNSEPRGDTYRAYNGCGGNSEPRGDTYRAYNGCGGNSEPRGDT YRAYNGCGGNSEPRGDTYRAYNGCGGNSEPRGDTYRAYNGCGGNSEPRGDTYRAYNG CGGNSEPRGDTYRAYNGCGGNSEPRGDTYRAYNGCGGNSEPRGDTYRAYNGCGGNSE PRGDTYRAYNGCGGNSEPRGDTYRAYNGCGGNSEPRGDTYRAYNGCGGNSEPRGDTY RAYNGGRGILEHHHHHH (SEQ ID NO: 68) or a protein sequence comprising an identity of at least about 80%, at least about 85%, at least about 90%, at least about 95%, at least about 96%, at least about 97%, at least about 98 or even %, at least about 99% to a protein according to SEQ ID NO: 68.

The double stranded nucleic acid sequence may be furthermore selected from a nucleic acid sequence comprising or consisting of a nucleic acid sequence selected from the sequences (SEQ ID NO: 69)
5'-GGTGGTCGACCTTCTGATTCTTACGGTGCTCCTGGTGGTGGTAAT-3';

(SEQ ID NO: 70)
5'-ACCATTACCACCACCAGGAGCACCGTAAGAATCAGAAGGTCGACC-3'

(SEQ ID NO: 71)
5'-GGTCGTGGTGGTCTGGGTGGTCAGGGTGCTGGTATGGCTGCTGCTG CTGC-3';

(SEQ ID NO: 72)
5'-TATGGGTGGTGCTGGTCAGGGTGGTTACGGTGGTCTGGGTTCTCAG GGTACCTCT-3';

(SEQ ID NO: 73)
5'-AGCACCACCCATAGCAGCAGCAGCAGCCATACCAGCACCCTGACCA CCCAGACCACCACG-3';

(SEQ ID NO: 74)
5'-ACCAGAGGTACCCTGAGAACCCAGACCACCGTAACCACCCTGACC-3';

or may be selected from a nucleic acid sequence comprising or consisting of a nucleic acid sequence comprising an identity of at least about 80%, at least about 85%, at least about 90%, at least about 95%, at least about 96%, at least about 97%, at least about 98 or even %, at least about 99% to one of the afore mentioned nucleic acid sequences according to any of SEQ ID NOs: 69 to 74.

Preferably, the double stranded nucleic acid sequences may, either separately or additionally, encode a further protein or amino acids, such as e.g. histidine (His), a protein comprising a tag for purification, a protease cleavage site, chemical cleavage sites, green fluorescent protein (GFP), enhanced cyan fluorescent protein (ECFP), enhanced yellow fluorescent protein (EYFP), signal epitopes, surface binding peptides, self-assembling sequences with amyloid like function, catalytically active sequences and enzymes, biopharmaceuticals, other structure proteins, signal epitopes, unnatural amino acids, receptors and ligands, etc.

Tags for purification in the context of the present invention may comprise e.g. a His$_6$-tag, a FLAG-tag, a HA-tag, a MYC tag, etc. Further purification tags are known to a skilled person and may be adapted and used as suitable as a fusion protein with a protein sequence as defined above.

Protease cleavage sites in the context of the present invention may comprise cleavage sites for endo or exo proteases, preferably selected from Factor XA, TEV, Thrombin, or as known for a skilled person, e.g. by data bases such as ExPASy Proteomics Server—PeptideCutter page etc.

Chemical cleavage sites in the context of the present invention may comprise sites cleavable by hydroxylamine. Such sites are preferably amino acids N-G (asparagine-glycine). Chemical cleavage sites may comprise sites cleavable by CNBr, metal catalyzed cleavage sequences, acids such as TFA, HCl, formic acid, iodosobenzoic acid, NTCB (2-nitro-5-thiocyanobenzoic acid), etc.

The double stranded nucleic acid sequence may be furthermore selected from a mixture of the afore herein defined nucleic acid sequences and hence may encode more than one protein or peptide as defined herein. According to a particularly preferred aspect, the or preferably each double stranded nucleic acid sequence as used according to the method of the present invention may thus encode a "monomer" (i.e. 1) or may encode already a "multimer" of proteins as defined herein, e.g. according to any of formulae I, Ia, Ib, Ic or Id etc., preferably a consecutive number of 2 to 100 proteins as defined herein, e.g. according to any of formulae I, Ia, Ib, Ic or Id etc., more preferably a consecutive number of 5 to 50 proteins as defined herein, e.g. according to any of formulae I, Ia, Ib, Ic or Id etc. Proteins in this context are preferably as defined above.

According to step d) of the inventive method for assembling multimeric protein or peptide structures circular ligation of the multiple number of double stranded nucleic acid sequences into the expression vector occurs preferably using a ligase. As a ligase, any ligase could be used known to a skilled person, e.g. DNA ligases, such as T4 DNA ligase, *E. coli* DNA ligase, Taq DNA ligase, etc. Preferably, T4 DNA ligase is used. During ligation, the digested vector assembled with multimeric nucleic acids encoding protein or peptide structures is ligated to contain covalently bound the multimeric nucleic acids encoding protein or peptide structures within the vector sequence, particularly between the first unique type II S restriction site and the second unique type II S restriction site as defined above, alternatively between the third unique restriction site and the second unique type II S restriction site as defined above. Thereby, a ligated circular expression vector is created, which preferably serves as a template vector in the further steps of the inventive methods.

Propagation of the ligated circular expression vector as obtained according to step d) is optional and may be carried out according to step e), if desired and necessary. For propagation the vector is preferably introduced into an expression system as defined above, e.g. an expression system as described in e.g. Sambrook et al.: Molecular cloning: A Laboratory Manual; 3$^{rd}$ Ed. Cold Spring Harbour Laboratory Press; Cold Spring Harbour (2001), and being selected from e.g. a prokaryotic expression system, a eukaryotic expression system, etc. Non-limiting examples of prokaryotic expression systems are, without being limited thereto, *Escherichia coli, Bacillus subtilis, Bacillus megaterium, Corynebacterium glutamicum*, and others. Nonlimiting examples of eukaryotic expression organisms are yeasts such as *Saccharomyces cerevisiae, Pichia pastoris*, and others, filamentose fungi such as *Aspergillus niger, Aspergillus oryzae, Aspergillus nidulans, Trichoderma reesei, Acremonium chrysogenum*, and others, mammalian cells such as HeLa-cells, COS cells, CHO cells, dendritic cells, B cells, K562 cells, and others, insect cells such as Sf9 cells, MEL cells, and others, plants or plant cells such as *Solanum tuberosum, Nicotiana*, and others. Non-limiting examples of archaea/extremophilic expression organisms are, without being limited thereto, *Methanococcus* species, e.g *Methanococcus jannaschii, Methanosarcina acetivorans, Sulfolobus solfataricus, Methanococcus mazei* and others. Subsequent to propagation, the ligated circular expression vector may be isolated and optionally purified.

Upon circular ligation and/or propagation the ligated circular expression vector obtained according to step d) or e) may be sequenced to determine and confirm the number of repetitions of the double stranded nucleic acid sequences inserted into the vector. The number of repetitions of the double stranded nucleic acid sequences inserted into the vector may be as defined above, e.g. about 1 to 100, more preferably about 1 to 60, even more preferably 1 to 40, even more preferably about 1 to 20, e.g. 1, 2, 3, 4, 5, 6, 7, 8, 9, 10, 11, 12, 13, 14, 15, 16, 7, 18, 19, 20, 2 to 10, etc. The inserts are preferably entirely oriented head to tail due to the specific selection of unique restriction sites, the designated non-palindromic overhangs and the cyclic and directional ligation method applied herein. Sequencing may occur using any suitable method known to a skilled person.

According to a further step g) of the inventive method, circular expression vectors obtained according to step d), e) and/or f) with a multiple number of the double stranded nucleic acid sequences in the expression vector may be selected dependent on a predetermined number of repetitions, to assure concise and reliable insertion of further sequence elements via directional insertion. Hence, according to a preferred aspect selection of circular expression vectors obtained according to step d), e) and/or f) is carried out, wherein the selected expression vectors comprise a predetermined number of double stranded nucleic acid sequences, preferably 2 to 15, more preferably at least 5, at least 10 or at least 15, e.g. 5, 10, or 15, more preferably about 5 to 10, even more preferably about 5 to 15, or more, e.g. 5, 6, 7, 8, 9, 10, 11, 12, 13, 14, or 15, or even more. Such a selection preferably provides a defined starting point for the further process, which allows inserting further double stranded nucleic acids as defined herein in further steps without the requirement of further sequencing such additional inserts or the corresponding vectors.

Once, such an expression vector with a predetermined number of repetitions of the double stranded nucleic acid sequences in the expression vector has been selected this selected vector may be used in further steps to carry out the inventive method.

According to a further particularly preferred aspect of the inventive method the selected expression vector comprising a predetermined number of repetitions of the double stranded nucleic acid sequences as selected according to step g) of the inventive method, may be digested again according to step h) using preferably the first type II S restriction enzyme as mentioned before, more preferably selected from BspQI. Digestion according to step h) of the inventive method may be carried out generally as defined above for step b) preferably using conditions as outlined above.

According to a further step i) of the inventive method a further double stranded nucleic acid sequence as defined herein may be inserted into the digested expression vector obtained according to step h) of the inventive method. The further double stranded nucleic acid sequence preferably again exhibits a 3 base pair 5'-overhang in the upper strand and a complementary 3 base pair 5'-overhang in the lower strand (or alternatively a 3 base pair 3'-overhang in the upper strand and a complementary 3 base pair 3'-overhang in the lower strand, if required) which are complementary to the corresponding overhang in the digested expression vector and may be identical or different to the overhangs provided with the double stranded nucleic acid sequence of step c). In this context, the term "complementary" is preferably defined with respect to the each end of the digested circular expression vector as defined herein and the corresponding end of an insert to be provided with regard to step i) of the inventive method. In other words, the 3 base pair 5'-overhang in the upper strand of the insert is preferably complementary with a corresponding 3 base pair 5'-overhang in the lower strand of the digested circular expression vector and a 3 base pair 5'-overhang in the lower strand of the insert is preferably complementary 3 base pair 5'-overhang in the upper strand of the digested circular expression vector. Likewise, the 3 base pair 3'-overhang in the upper strand of the insert is preferably complementary to a corresponding 3 base pair 3'-overhang in the lower strand of the digested circular expression vector and a 3 base pair 3'-overhang in the lower strand of the insert is preferably complementary to a 3 base pair 3'-overhang in the upper strand of the digested circular expression vector.

Such a further double stranded nucleic acid sequence may be any double stranded nucleic acid sequence as defined herein, preferably encoding a protein as defined herein, e.g. a protein according to any of formulae I, Ia, Ib, Ic or Id etc., as defined herein, or any further suitable protein. Such a protein, encoded by the further double stranded nucleic acid sequence, may be identical or different to the protein as defined in step c) of the inventive method for assembling multimeric protein or peptide structures.

According to further step j) of the inventive method for assembling multimeric protein or peptide structures, the inserted further double stranded nucleic acid sequence of step i) may be preferably ligated into the digested vector to obtain again a circular expression vector (circular ligation) comprising further the double stranded nucleic acid sequence of step i) covalently bound with the vector. Ligation is preferably carried out as outlined above for step d) using ligase and reaction conditions outlined above.

According to a further optional step k) the steps h) to j) of the inventive method for assembling multimeric protein or peptide structures are repeated preferably at least once. Typically, the number of repetitions in step k is 1 to 600, preferably 2 to 600, more preferably 1 to 500, 1 to 400, 1 to 300, 1 to 200, 1 to 100, 1 to 50, 5 to 300, 5 to 200, 5 to 100, 5 to 50, 5 to 40, 5 to 30, 5 to 25, 5 to 20, 5 to 15, 5 to 10, 2 to 100, 2 to 50, 2 to 40, 2 to 30, 2 to 25, 2 to 20, 2 to 15, 2 to 10, such as 5, 10, 15, 20, 25, 30, 40, 50, etc. Hence, the multimeric protein or peptide structures may contain 1 to 600, preferably 2 to 600, more preferably 1 to 500, 1 to 400, 1 to 300, 1 to 200, 1 to 100, 1 to 50, 5 to 300, 5 to 200, 5 to 100, 5 to 50, 5 to 40, 5 to 30, 5 to 25, 5 to 20, 5 to 15, 5 to 10, 2 to 100, 2 to 50, 2 to 40, 2 to 30, 2 to 25, 2 to 20, 2 to 15, 2 to 10, such as 5, 10, 15, 20, 25, 30, 40, 50, etc. repetitions of a double stranded nucleic acid as defined herein, each double stranded nucleic acid preferably encoding either the same or different protein(s), such that the resulting multimeric protein may be homopolymeric or may occur as a blockpolymer, etc.

Prior to the step 1) of the inventive method, the assembled multimeric nucleic acids obtained through steps h) to k) of the inventive method, which are contained in the circular expression vector and encode thus an assembled multimeric protein or peptide structure, may be further elongated by a further optional step (additional elongation step). To be noted in this context, the location of the inventive unique restriction sites in a vector as described herein allows advantageously to create freely selectable complementary overhangs using type II S restriction enzymes and recognition sequences for the first and the second type II S restriction enzymes and recognition sequences, and to furthermore elongate/double the multimeric sequence obtained by the inventive method even further by digesting the vector as described above utilizing the third unique restriction site and to insert a correspondingly digested insert. Depending on the sequence and length of an insert the further elongation without providing incompatible overhangs to the inserts may immediately lead to self-ligation of the complementary overhangs of the provided inserts, which prevents from any further elongation of the multimeric protein or peptide polymer. Hence, the inventive elongation of the insert allows yielding a protein far beyond lengths which could be obtained by methods of the art.

Such a further optional elongation step may be carried out utilizing the third unique restriction site contained in the inventive vector, preferably in the inventive circular expression vector, as defined herein. For this purpose preferably the circular expression vector selected according to step g) and preferably further processed according to steps h) to k) as defined above may be digested with the first type II S restriction enzyme and preferably subsequently digested with the type II or type II S restriction enzyme recognizing the third unique recognition sequence and restriction site. Digestion preferably may be carried out generally as defined above for steps b) and h) preferably using conditions as outlined above. As defined before, the third unique restriction enzymes, e.g. type II or type II S restriction enzymes, are preferably selected from any suitable type II or type II S restriction enzyme, such as e.g. SacI or BsmAI, etc. The vector obtained in this substep is then preferably used as a template vector in the next substep. The template vector may be purified, if necessary and suitable, e.g. by size exclusion chromatography, or any further suitable method to discard short cleavage products.

Furthermore, for the purpose of this optional elongation step of the inventive method a corresponding insert is prepared. Therefore, preferably the circular expression vector selected according to step g) and preferably further processed according to steps h) to k) as defined above may be digested with the third unique restriction enzyme first and subsequently digested with the second type II S restriction enzyme or in parallel (depending on the chosen restriction enzyme), preferably in one reaction. This digestion for the preparation of the insert typically yields as an insert a short cleavage product, the insert, and a long cleavage product, the digested vector. The insert may be isolated, if desired, preferably using size exclusion chromatography, etc. or any further suitable method, and the digested vector may be discarded. Digestion preferably may be carried out generally as defined above for steps b) and h) preferably using conditions as outlined above. As defined before, the third unique type II or type II S restriction enzymes are preferably selected from any suitable type II or type II S restriction enzymes, such as e.g. SacI or BsmAI, etc.

Hence, a template vector is generated with incompatible overhangs, which could not undergo self ligation and an insert is generated with incompatible overhangs, which could not undergo self ligation. However, the corresponding ends of the template vector and the insert are compatible with each other such as to allow ligation of the ends of the template vector and the insert to form a circular expression vector. According to a further substep the insert then may be inserted into the template vector and a circular ligation may be carried out using a ligase, preferably as defined herein.

Such an defined optional elongation step of the inventive method allows to effectively elongate the size of the insert (iteratively) of the circular expression vector selected according to step g) and preferably further processed according to steps h) to k) as defined above to selectively insert defined sequences of a defined final multiplicity in order to create a defined number or repeats or to selectively insert additional sequence blocks.

According to an optional final step 1) the protein encoded by the multimeric protein or peptide structures as obtained by step k) is preferably expressed and optionally isolated. In the context of the present invention, the term "expression" is preferably used in its most general meaning and comprises the production of RNA or of RNA and protein as defined herein. It also comprises partial expression of nucleic acids as defined herein. Furthermore, expression may be carried out transiently or stably. Preferably, the term comprises production of protein encoded by the multimeric protein or peptide structures as obtained by step k) of the inventive method for assembling multimeric protein or peptide structures.

According to a particular aspect, the inventive method for assembling multimeric protein or peptide structures preferably may be used as a novel scalable peptide generator technique, which is thus also described. This scalable peptide generator technique is preferably based on an inventive method as defined herein for assembling multimeric protein or peptide structures, preferably including steps as shown above, wherein the finally expressed and optionally purified assembled multimeric protein or peptide structures are then specifically degraded/cleaved into their monomeric proteins or peptides or at least into smaller units via cleavage of at least one cleavable protein sequence preferably contained in such a multimeric protein or peptide structure. A cleavable protein sequence in this context is preferably a protease recognition sequence, a chemical cleavage site, a cleavage site for a hydroxylamine cleavage, etc. preferably as defined above. Such a protease recognition sequence, a chemical cleavage site, a cleavage site for a hydroxylamine cleavage is preferably located at the N-/or C-terminal end of a (monomeric) peptide or protein as described herein forming part of the multimeric protein or peptide structure. Specifically preferred for such a process the herein defined double stranded nucleic acid sequences encoding a peptide or protein are provided together with a cleavable protein sequence such that the assembled multimeric protein or peptide structures comprise the peptide or protein sequence and the cleavable protein sequence in an alternating order. For this purpose, preferably in steps h) and i) of the inventive method, double stranded nucleic acids as defined herein are provided in an order such that the resulting multimeric double stranded nucleic acid sequence encodes in alternating order a peptide or protein as defined herein and then a cleavable protein sequence. The repetition of such a "block" may be as defined above in general for repetitions of nucleic acids and their encoded proteins as defined above. Alternatively, a double stranded nucleic acid sequences encoding a peptide or protein and a double stranded nucleic acid sequences encoding a cleavable protein sequence may be provided subsequently in steps h) and i) upon repetition of said steps. Thus, preferably in step i) of the inventive method a double stranded nucleic acid is provided encoding a protein as defined herein and in a subsequently following repetition of steps h) to j) a double stranded nucleic is provided encoding a cleavable protein sequence selected from a chemical cleavage site or a protease cleavage site or a hydroxyl amine cleavage site at one of its terminal ends. Alternatively, in step i) a double stranded nucleic acid may be provided encoding a protein as defined herein and additionally a cleavable protein sequence, e.g. a protease cleavage site or a hydroxyl amine cleavage site, preferably at one of its terminal ends.

After preparation of a circular expression vector encoding a multimeric protein structure according to the novel scalable peptide generator technique the encoded protein or peptide structure is optionally expressed and optionally isolated according to step 1) of the inventive method. Then, following a preferably final step, the expressed and optionally isolated multimeric protein or peptide structure may be specifically degraded/cleaved into its "monomeric units" by using a suitable chemical compound or protease, etc. as defined above, capable to cleave the cleavage site. Preferably, the size of each monomeric unit is characterized by the cleavable protein sequence as defined herein attached thereto. Such degradation/cleavage may occur by adding such a suitable chemical or protease, etc. as defined above, capable to cleave the cleavage sites contained in the multimeric protein or peptide structure, The reaction conditions, which may be applied in cleavage reaction typically depend on the type of suitable chemical or protease added in the reaction and are typically known to a skilled person. This allows providing in an easy and controllable manner proteins with a high yield which could be further processed or used in other applications, even without further purification.

Upon cleavage, short fragments of the multimeric protein or peptide structures can be provided, which may represent protein or peptide structures of a defined length, preferably the corresponding monomeric protein or peptide structures. Such short cleavage products of inventive multimeric protein or peptide structures preferably have a length of e.g. 5 to 100 amino acids or even more. Hence, the inventive method for assembling multimeric protein or peptide structures advantageously may be used to highly effective and cost efficiently provide (monomeric or oligomeric) peptides far beyond kilogram scale. Particularly peptides or short proteins would be normally degraded in a cell or cellular environment within short time range, thus production of these molecules is only possible with very expensive chemical synthesis instead of using inexpensive, reliable and scalable recombinant expression techniques. Such proteins or peptides may also contain tags for purification as defined herein, which allow for purification of the entire multimeric protein or peptide structure, if e.g. one such tag is inserted for the entire multimeric protein or peptide structure, or the different protein units, e.g. if each protein unit further comprises such a tag for purification. This allows obtaining short peptide fragments with high quantity and high purity, e.g. in a scale of more than 100 mg per Liter without any further optimization. Such a method may be suitable to provide efficiently peptide drugs, growth factors, epitopes, antigens, e.g. for vaccine production, epitopes of antigens, and other proteins and peptides in large scale and high purities. The novel scalable peptide generator technique as described above thus indeed advantageously allows scalable technical production of proteins and peptides.

According to a further embodiment, the present invention provides proteins, preferably obtained or obtainable by the inventive method for assembling multimeric protein or peptide structures or which may be further used herein. Such proteins are preferably encoded by a double stranded nucleic acid as defined above or comprise a peptide or protein sequence encoded by a double stranded nucleic acid as defined above.

Particularly preferably, a protein as obtained by the inventive method for assembling multimeric protein or peptide structures or which may be further used herein comprises or consists of an ELP-like protein sequence according to the following general formula (I):

$$[(VZ_1PZ_2GX_1G)_n(VZ_3PZ_4GX_2G)_m]_p$$ 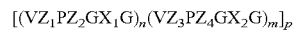 (SEQ ID NO: 95)

wherein:
V is Val
P is Pro;
G is Gly;
$X_1$ is Glu, Asp, Arg, Val, Lys, His, Ser, Thr, Asn or Gln, or is a non-naturally occurring amino acid, or is a mixture thereof;
$X_2$ is Tyr, Cys, Phe, Ile, Leu, Met, Val or Trp, or is a non-naturally occurring amino acid, or is a mixture thereof;
$Z_{1-4}$ is present or is not present and is independently from each other selected from Ala or Gly;
n+m≥1
n is an integer selected from 0 or 1 to 300;
m is an integer selected from 0 or 1 to 300;
p is an integer selected from 1 to 300;

Even more preferably, such a protein as obtained by the inventive method for assembling multimeric protein or peptide structures or which may be further used herein comprises or consists of a resilintype ELP-like protein sequence according to the following general formula (Ia):

$$[(VPGVG)_n(VPGX_2G)_m]_p$$ 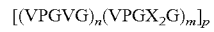 (SEQ ID NO: 96)

wherein:
V is Val
P is Pro;
G is Gly;
V is Val
$X_2$ is Tyr or Cys;
n+m≥1
n is an integer selected from 0 or 1 to 300, preferably 0 or 1 to 25;
m is an integer selected from 1 to 300, preferably 1 to 100;
p is an integer selected from 1 to 300, preferably 3 to 300;

Most preferably, such a resilintype ELP-like protein sequence as obtained by the inventive method for assembling multimeric protein or peptide structures or which may be further used herein comprises or consists of a resilintype ELP-like protein sequence according to any of the following formulae:

$$[(VPGVG)_{0-25}(VPGYG)_{1-100}]_{3-300}$$  (SEQ ID NO: 97)

$$[(VPGVG)_{1-10}(VPGYG)_{1-5}]_{3-200}$$ 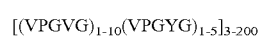 (SEQ ID NO: 98)

| | |
|---|---|
| [(VPGVG)$_{1-10}$(VPGYG)$_1$]$_{3-200}$ | (SEQ ID NO: 99) |
| [(VPGVG)$_{1-5}$(VPGYG)$_1$]$_{3-200}$ | (SEQ ID NO: 100) |
| [(VPGVG)$_2$(VPGYG)$_1$]$_{3-200}$ | (SEQ ID NO: 101) |
| [(VPGVG)$_2$(VPGYG)$_1$]$_{10-100}$ | (SEQ ID NO: 102) |
| [(VPGVG)$_2$(VPGYG)$_1$]$_{10-50}$ | (SEQ ID NO: 103) |
| [(VPGVG)$_2$(VPGYG)$_1$]$_{15}$ | (SEQ ID NO: 104) |
| [(VPGVG)$_{0-25}$(VPGCG)$_{1-100}$]$_{3-300}$ | (SEQ ID NO: 105) |
| [(VPGVG)$_{1-10}$(VPGCG)$_{1-5}$]$_{3-200}$ | (SEQ ID NO: 106) |
| [(VPGVG)$_{1-10}$(VPGCG)$_1$]$_{3-200}$ | (SEQ ID NO: 107) |
| [(VPGVG)$_{1-5}$(VPGCG)$_1$]$_{3-200}$ | (SEQ ID NO: 108) |
| [(VPGVG)$_2$(VPGCG)$_1$]$_{3-200}$ | (SEQ ID NO: 109) |
| [(VPGVG)$_2$(VPGCG)$_1$]$_{10-100}$ | (SEQ ID NO: 110) |
| [(VPGVG)$_2$(VPGCG)$_1$]$_{10-50}$ | (SEQ ID NO: 111), or |
| [(VPGVG)$_2$(VPGCG)$_1$]$_{15}$ | (SEQ ID NO: 112). |

(In any of the above ranges the integer "0" may be replaced independently by any of the integers 1, 2 or 3).

According to a further aspect a protein as obtained by the inventive method for assembling multimeric protein or peptide structures or which may be further used herein comprises or consists of an amphiphilic ELP-like protein sequence according to the following general formula (Ib):

[(VZ$_1$PZ$_2$GX$_1$G)$_n$(VZ$_3$PZ$_4$GX$_2$G)$_m$]$_p$   (SEQ ID NO: 95)

or according to following general formula (Ic):

[(VPGX$_1$G)$_n$(VPGX$_2$G)$_m$]$_p$   (SEQ ID NO: 113)

or according to following general formula (Id):

[Y$_q$(VPGX$_1$G)$_n$Y$_q$(VPGX$_2$G)$_m$Y$_q$]$_p$   (SEQ ID NO: 114)

wherein (in Ib or Ic or Id):
V is Val
P is Pro;
G is Gly;
X$_1$ is Glu, Asp, Arg, Val, Lys, His, Ser, Thr, Asn or Gln, or is a non-naturally occurring amino acid, or is a mixture thereof;
X$_2$ is Tyr, Cys, Phe, Ile, Leu, Met, Val or Trp, or is a non-naturally occurring amino acid, or is a mixture thereof;
wherein X$_1$ and X$_2$ are preferably interchanged in the general formulas in Ib or Ic or Id
Y is GFP (green fluorescent protein), mEGFP (monomeric enhanced GFP), EYFP (enhanced yellow fluorescent protein), ECFP (enhanced cyan fluorescent protein) or any further suitable fluorescent proteins or derivative or a mixture thereof
Z$_1$ to Z$_4$ is present or is not present and is independently from each other selected from Ala or Gly;
n+m≥1
n is an integer selected from 1 to 300;
m is an integer selected from 1 to 300;
p is an integer selected from 1 to 300;
q is an integer of 0 or 1

Particularly preferably, such an ELP-like protein sequence as obtained by the inventive method for assembling multimeric protein or peptide structures or which may be further used herein comprises or consists of an amphiphilic ELP-like protein sequence according to one of the following formulae:

| | |
|---|---|
| [(VPGX$_1$G)$_{0-300}$(VPGX$_2$G)$_{0-300}$]$_{1-300}$ | (SEQ ID NO: 115) |
| [(VPGX$_1$G)$_{0-200}$(VPGX$_2$G)$_{0-200}$]$_{1-200}$ | (SEQ ID NO: 116) |
| [(VPGX$_1$G)$_{0-100}$(VPGX$_2$G)$_{0-100}$]$_{1-100}$ | (SEQ ID NO: 117) |
| [(VPGX$_1$G)$_{5-100}$(VPGX$_2$G)$_{5-100}$]$_{1-50}$ | (SEQ ID NO: 118) |
| [(VPGX$_1$G)$_{5-100}$(VPGX$_2$G)$_{5-100}$]$_1$ | (SEQ ID NO: 119) |
| [(VPGX$_1$G)$_{10-50}$(VPGX$_2$G)$_{10-50}$]$_1$ | (SEQ ID NO: 120) | wherein:
V is Val
P is Pro;
G is Gly;
X$_1$ is Glu, Asp, Arg, or a mixture thereof
X$_2$ is Phe, Ile, Leu, or a mixture thereof,
(In any of the above ranges the integer "0" may be replaced independently by any of the integers 1, 2 or 3).

Likewise preferably, such an ELP-like protein sequence as obtained by the inventive method for assembling multimeric protein or peptide structures or which may be further used herein comprises or consists of an amphiphilic ELP-like protein sequence according to one of the following formulae:

| | |
|---|---|
| [Y$_q$(VPGX$_1$G)$_{0-300}$Y$_q$(VPGX$_2$G)$_{0-300}$Y$_q$]$_{1-300}$ | (SEQ ID NO: 121) |
| [Y$_q$(VPGX$_1$G)$_{0-200}$Y$_q$(VPGX$_2$G)$_{0-200}$Y$_q$]$_{1-200}$ | (SEQ ID NO: 122) |
| [Y$_q$(VPGX$_1$G)$_{0-100}$Y$_q$(VPGX$_2$G)$_{0-100}$Y$_q$]$_{1-100}$ | (SEQ ID NO: 123) |
| [Y$_q$(VPGX$_1$G)$_{2-100}$Y$_q$(VPGX$_2$G)$_{2-100}$Y$_q$]$_{1-50}$ | (SEQ ID NO: 124) |
| [Y$_q$(VPGX$_1$G)$_{5-100}$Y$_q$(VPGX$_2$G)$_{5-100}$Y$_q$]$_1$ | (SEQ ID NO: 125), |
| [Y$_q$(VPGX$_1$G)$_{10-50}$Y$_q$(VPGX$_2$G)$_{10-50}$Y$_q$]$_1$ | (SEQ ID NO: 126) | wherein:
V is Val
P is Pro;
G is Gly;
X$_1$ is Glu, Asp, Arg, (Lys, Asn, Gln, Ser, Thr, His) or is a mixture thereof;
X$_2$ is Phe, Ile, Leu, (Tyr, Trp, Meth, Val) or is a mixture thereof,
Y is GFP (green fluorescent protein), mEGFP (monomeric enhanced GFP), EYFP (enhanced yellow fluorescent protein), ECFP (enhanced cyan fluorescent protein) or any further suitable fluorescent proteins or derivative or a mixture thereof
q is an integer of 0 or 1

The multimerised peptide may contain a C- and/or N-terminal tag in order to remove all non target sequences, preferably a tag for purification as defined above.

According to one aspect of the present invention, the protein or peptide as obtained or obtainable by the inventive method for assembling multimeric protein or peptide structures is comprises a peptide or protein as defined herein together with a cleavable protein sequence as defined herein such that the peptide or protein sequence and the cleavable protein sequence occur (preferably as a "block") in an alternating order, preferably with a number of repetitions as defined herein, e.g. the number of repetitions may be 1 to 600, preferably 2 to 600, more preferably 1 to 500, 1 to 400, 1 to 300, 1 to 200, 1 to 100, 1 to 50, 5 to 300, 5 to 200, 5 to 100, 5 to 50, 5 to 40, 5 to 30, 5 to 25, 5 to 20, 5 to 15, 5 to 10, 2 to 100, 2 to 50, 2 to 40, 2 to 30, 2 to 25, 2 to 20, 2 to 15, 2 to 10, such as 5, 10, 15, 20, 25, 30, 40, 50, etc.

According to a further aspect of the present invention, the protein or peptide structure as obtained or obtainable by the inventive method for assembling multimeric protein or peptide structures comprises or consists of a protein or peptide selected from a peptide drug, a growth factor, an epitope, an antigen, e.g. for vaccine production, an epitope of an antigen, or any further protein or peptide.

According to another aspect of the present invention, the protein or peptide as obtained or obtainable by the inventive method for assembling multimeric protein or peptide structures comprises or consists of a protein as defined herein, preferably comprising or consisting of an amino acid sequence according to any of SEQ ID NOs: 2, 4, 6, 8, 10, 12, 14, 16, 18, 20, 22, 24, 26, 28, 30, 32, 34, 36, 38, 40, 42 to 77 or 80 to 89, or a protein comprising an identity of at least about 80%, at least about 85%, at least about 90%, at least about 95%, at least about 96%, at least about 97%, at least about 98 or even %, at least about 99% to a protein according to any of SEQ ID NOs: 2, 4, 6, 8, 10, 12, 14, 16, 18, 20, 22, 24, 26, 28, 30, 32, 34, 36, 38, 40, 42 to 77 or 80 to 89, or is a protein encoded by a nucleic acid as defined above.

Such multimeric protein or peptide structures obtained or obtainable by the method according to the present invention may be even further multimerised in addition to the steps of the inventive method shown above. For this purpose preferably such multimeric protein or peptide structures as defined above may be further assembled such that homogeneous polymers or block polymers or co-polymers of larger size may be generated, wherein each block may be formed by one multimeric protein or peptide structure as defined herein.

According to one further aspect the inventive multimeric protein or peptide structures obtained or obtainable by the inventive method may occur as (mixed) multimeric protein or peptide structures with predetermined structures, e.g. as a homopolymeric or as a heteropolymeric multimeric protein or peptide structure, as a blockpolymer, as a copolymer, as a blockcopolymer, etc. The general structure of such multimeric protein or peptide structures may be, without being limited thereto, e.g. AAA . . . , BBB . . . , CCC . . . , AB . . . , AABB . . . , AAABBB . . . , AAAABBBB . . . , ABAABAABAABAABA . . . , ABC . . . , ABAB . . . , ABCABC . . . , ABCDABCDABCD . . . , etc. or any further structure suitable for a blockpolymer or a copolymer, wherein A, B, C, D, etc are representative for a protein or peptide or a multimerized a protein or peptide structure as defined herein, or a mix thereof. As an example, combined or alternating blocks of adhesion peptides or signal peptides with enzymatic or chemical cleavage sites may be prepared.

For this purpose, preferably double stranded nucleic acids encoding for the same or for different proteins, multimeric protein peptide structures, or mixes thereof, may be added, e.g. in the inventive method, preferably in the course of steps h) and i), in a desired order and/or amounts and ligated to obtain a predetermined structure. In the inventive method this occurs preferably in the context of digesting the circular expression vector, inserting into the digested expression vector a further double stranded nucleic acid sequence, ligating same and repeating these steps (preferably steps h) to j)) at least once, preferably with a repetition number as defined herein. Hence, such structures, blockpolymers and co-polymers may of course, preferably be obtained using the inventive process for multimerising protein or peptide structures by selectively directing the addition of doublestranded nucleic acid molecules as defined herein encoding proteins or peptides as defined herein. Preparation of such structures, however, may also occur on basis of the double stranded nucleic acids as such without using a vector as described herein or even on basis of the expressed multimeric proteins or peptides.

Generally for any such inventive methods the double stranded nucleic acids may be provided in the desired order and amounts. "Desired order and amounts" preferably means that these double stranded nucleic acids encoding different proteins or multimeric protein or peptide structures as defined herein may be selected independently from double stranded nucleic acids encoding the same or different inventive proteins or multimeric protein or peptide structures. Such double stranded nucleic acids may also comprise mixes of different double stranded nucleic acids, hence encoding different proteins or multimeric protein or peptide structures as defined herein. For the purposes of the present invention such double stranded nucleic acid sequences, preferably in the presence of a ligase as defined herein, may be ligated with each other or with a vector, i.e. an expression vector or a cloning vector, as described herein. Such a ligation typically leads to circularized double stranded nucleic acids (with or without a vector) encoding multimeric protein or peptide structures, which contain several multimeric protein or peptide structures, comprising preferably at least one protein or peptide as defined above, more preferably 1 to 10.000, 10 to 1.000, 100 to 10.000 proteins or peptides defined herein, even more preferably 1 to 1.000 or even 1 to 600, likewise preferably 2 to 600, 1 to 500, 1 to 400, 1 to 300, 1 to 200, 1 to 100, 1 to 50, 5 to 300, 5 to 200, 5 to 100, 5 to 50, 5 to 40, 5 to 30, 5 to 25, 5 to 20, 5 to 15, 5 to 10, 2 to 100, 2 to 50, 2 to 40, 2 to 30, 2 to 25, 2 to 20, 2 to 15, 2 to 10 proteins or peptides as defined herein, such as 5, 10, 15, 20, 25, 30, 40, 50, etc. repetitions of a proteins or peptides as defined herein.

By preferably selectively adjusting the reaction temperature of the inventive method to the preferred reaction temperatures of the enzymes used in such an approach (according to the manufacturer's instructions) and selectively carrying out digestion and cyclic ligation step by step in a cyclic order, the inventive method can be carried out quasi continuously. The reaction may be carried out in one reaction chamber or tube.

For the purposes of the present invention, the proteins prepared using the inventive method for assembling multimeric protein or peptide structures may also comprise "derivatives" of such multimeric protein or peptide structures. In this context, "derivatives" preferably means that a protein or peptide sequence or the multimeric protein or peptide structures as defined herein may comprise amino acid insertion variants, amino acid deletion variants and/or amino acid substitution variants. "Derivatives" preferably have a sequence identity to the herein described sequences of at least 90%, more preferably of at least 95%, 98% or even 99%.

In order to determine the percentage to which two sequences (nucleic acid sequences as defined herein or amino acid sequences) are identical, the sequences can be aligned in order to be subsequently compared to one another. Therefore, e.g. gaps can be inserted into the sequence of the first sequence and the component at the corresponding position of the second sequence can be compared. If a position in the first sequence is occupied by the same component as is the case at a position in the second sequence, the two sequences are identical at this position. The percentage to which two sequences are identical is a function of the number of identical positions divided by the total number of positions. The percentage to which two sequences are identical can be determined using a mathematical algorithm. A preferred, but not limiting, example of a mathematical algorithm which can be used is the algorithm of Karlin et al. (1993), PNAS USA, 90:5873-5877 or Altschul et al. (1997), Nucleic Acids Res., 25:3389-3402. Such an algorithm is integrated in the BLAST program. Sequences which are identical to the sequences of the present invention to a certain extent can be identified by this program. Any further algorithm may be used suitable to identify a homology between two sequences.

Derivatives as defined before are typically due to non-directed and randomly occurring translation errors during expression of the encoded proteins or at an earlier stage during assembling the nucleic acid sequences for the multimeric protein or peptide structures following the inventive method. The latter may be prevented if the finally obtained expression vector is sequenced and the sequence is confirmed. Although sequencing of long DNA templates (e.g. larger 1000 nucleotides) for homogenic multimeric proteins or peptide multimers is not possible (if polymeric blocks are not interrupted by unique sequence stretches to allow defined sequencing and verification of target templates) incorrect molecules could be verified by standard analytical methods such as e.g. SDS-PAG or mass spectrometric. Since, however, such derivatives using the inventive method are typically not measurable if at all present, small amounts of such derivatives may be tolerated in the final product to prevent further extensive sequencing of the finally obtained expression vector and to ensure a quick preparation and processing of the proteins.

In the above context, amino acid insertion variants typically comprise amino- and/or carboxy-terminal fusions and also insertions of single or two or more amino acids in a particular amino acid sequence. In the case of amino acid sequence variants having an insertion, one or more amino acid residues are inserted into a particular site in an amino acid sequence, although random insertion is also possible. Amino acid deletion variants are characterized by the removal of one or more amino acids from the sequence. Amino acid substitution variants are characterized by at least one residue in the sequence being removed and another residue being inserted in its place. Preference is given to the modifications being in positions in the amino acid sequence which are not conserved between homologous proteins or polypeptides. Preference is given to replacing amino acids with other ones having similar properties such as hydrophobicity, hydrophilicity, electronegativity, volume of the side chain and the like (conservative substitution). Conservative substitutions, for example, relate to the exchange of one amino acid with another amino acid listed below in the same group as the amino acid to be substituted:

1. small aliphatic, nonpolar or slightly polar residues: Ala, Ser, Thr (Pro, Gly)
2. negatively charged residues and their amides: Asn, Asp, Glu, Gln
3. positively charged residues: His, Arg, Lys
4. large aliphatic, nonpolar residues: Met, Leu, Ile, Val, (Cys)
5. large aromatic residues: Phe, Tyr, Trp.

Even though it is preferable that no derivatives are produced using the inventive method, such derivatives may be tolerated in the obtained multimeric protein or peptide structures and hence also in the corresponding vector sequences and nucleic acid sequences preferably to an extent as outlined above. Typically, such derivatives do not exhibit any detectable effect on the desired properties of the multimeric protein or peptide structures.

Multimeric protein or peptide structures as defined above may additionally comprise a tag for purification at their N- or C-terminal end, preferably at their C-terminal end. Such a tag for purification is preferably as defined above. The tag may be introduced either via a protein or peptide as defined above used to prepare multimeric protein or peptide structures or may be inserted into the vector as defined herein by directional insertion prior to carrying out the inventive method.

In the defined inventive linker region (FIG. 17) of the cloning and expression vectors used in the inventive method the emerging polymer template is typically provided with a histidin (His6) tag at the C-terminal end. Prior or following to the inventive cyclic multimerisation process this His6 tag could be removed, exchanged or supplemented by a C-terminal Cys amino acid by simple enzymatic digest reactions with defined restriction enzymes and subsequent ligation step on DNA level, prior to protein expression. For example restriction digest with EcoRI and MfeI followed by a ligation reaction removes the C-terminal His6 tag or the restriction digest with AatII followed by the removal of the generated overhangs with Mung Bean Nuclease followed by a ligation reaction lead to an addition of a C-terminal Cys amino acid to the His6 tagged protein.

Multimeric protein or peptide structures as defined above may additionally comprise a cysteine or histidine moiety at their N- and/or C-terminal end, preferably at their C-terminal end. Such an additional cysteine or histidine may be introduced either via a protein or peptide as defined above used to prepare multimeric protein or peptide structures or may be inserted into the vector as defined herein by directional insertion prior to carrying out the inventive method. If a tag for purification is contained in the vector or protein, typically at the C-terminus, such a cysteine or histidine may be located preferably C-terminally to such a tag for purification. Such a terminal cysteine may allow for coupling the inventive multimeric protein or peptide structures as defined above or polymers prepared therefrom to a surface or may allow for crosslinking the multimeric protein or peptide structures as defined above via their terminal end. A Cys-moiety may also be contained at the C- and the N-terminal end.

The present invention also comprises multimeric protein or peptide structures which comprise a sequence having a sequence identity of at least about 80%, at least about 85%, at least about 90%, at least about 95%, at least about 96%, at least about 97%, at least about 98 or even %, at least about 99% to a multimeric protein or peptide structures as defined above.

According to a further embodiment, the present invention also provides nucleic acid molecules encoding a protein as defined above. Such a nucleic acid molecule is either a single stranded or a double stranded nucleic acid molecule, preferably a single stranded nucleic acid molecule.

More preferably, such a double stranded nucleic acid molecule has a 3 base pair 5'-overhang in the upper strand and a 3 base pair 5'-overhang in the lower strand", preferably a 3 base pair 5'-overhang in the upper strand having the sequence GGT and a 3 base pair 5'-overhang in the lower strand having the sequence ACC. Such a double stranded nucleic acid molecule preferably has the general structure:

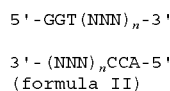

wherein N represents any nucleic acid, preferably NNN representing one or more double stranded nucleic acid molecules as defined herein that represents one or multiples (n) of any amino acid codon, and n may an integer selected from any number, preferably from 1 to 1500, more preferably from 1 to 900, even more preferably from 1 to 500, 1 to 400, 1 to 300, 5 to 500, 5 to 400, 5 to 300, Likewise preferably, such a double stranded nucleic acid molecule as defined above encodes a protein as defined herein, e.g. a protein according to any of formulae I, Ia, Ib, Ic or Id etc., as defined herein, or any further suitable protein, and exhibits a general structure as defined according to formula (II). Such sticky ends generated provided with the double stranded nucleic acid sequence allow a direct use of such nucleic acids in the inventive method for assembling multimeric protein or peptide structures.

Such a double stranded nucleic acid may also (alternatively or additionally) encode a monomer (i.e. 1) or a multimer of proteins according to any of formulae I, Ia, Ib, Ic or Id etc., etc. or any further suitable protein, preferably a consecutive number of 2 to 100 proteins as defined herein, more preferably a consecutive number of 5 to 50 proteins as defined herein.

The present invention also comprises nucleic acid sequences having a sequence identity of at least about 80%, at least about 85%, at least about 90%, at least about 95%, at least about 96%, at least about 97%, at least about 98 or even %, at least about 99% to a (double stranded) nucleic acid sequence as defined above.

According to a further embodiment, the present invention also provides an expression vector or a cloning vector as described herein, comprising a nucleic acid as defined herein, preferably encoding a protein as defined herein.

According to a particularly important embodiment of the present invention protein or peptide based polymers are provided. Formation of such protein or peptide based polymers may occur via non-covalent interactions, for example due to formation of intermolecular beta-sheet crystals, or covalent bonds, for example due to crosslinking reactions. Preferably, such protein or peptide based polymers are prepared by crosslinking a multimeric protein or peptide as defined herein, wherein the multimeric proteins or peptides used for crosslinking are preferably obtained or obtainable by the inventive method for assembling multimeric protein or peptide structures. Hence, a peptide based polymer is provided comprising a multimeric protein or peptide structure as defined herein wherein the multimeric protein or peptide structure(s) has been crosslinked with each other.

Such a crosslinking may be carried out using any suitable method known to a skilled person. As an example, crosslinking may be carried out via cysteine or tyrosine moieties, preferably contained in the multimeric protein or peptide and/or using a chemical crosslinker or an UV-active crosslinker or UV-activation in the presence of an oxidation agent and a redox catalyst.

In this context, a chemical crosslinker is preferably a molecule in which at least two chemically reactive groups are connected to one another via a linker. Examples thereof are sulfhydryl-reactive groups (e.g. maleimides, pydridyl disulfides, [alpha]-haloacetyls, double bonds (for photo-triggered thio-ene reactions), vinyl sulfones, sulfato alkyl sulfones (preferably sulfato ethyl sulfones), dienes and dienophiles (diels-alder reaction), photocyclization reactions (e.g. between cinnamyl residues, etc.), amine-reactive groups (e.g. succinimidyl esters, carbodiimides, hydroxymethyl, phosphine, imidoesters, PFP esters, aldehydes, isothiocyanates, etc.), carboxy-reactive groups (e.g. amines, etc.), hydroxyl-reactive groups (e.g. isocyanates, etc.), unselective groups (e.g. aryl azides, alkynes, etc.), and photo-activatable groups (e.g. perfluorophenyl azide, benzophenone etc.). These reactive groups may form covalent linkages with amine, thiol, carboxyl or hydroxyl groups present in proteins or unnatural amino acids with bioorthogonal site groups undergoing any of the reactions mentioned above. An UV-crosslinking may be carried out with photo-activatable groups, e.g. perfluorophenyl azide, benzophenone, etc., as defined herein.

According to a particularly preferred aspect, formation of protein or peptide based polymers starting from multimeric proteins or peptides as prepared with the inventive method may be carried out via cysteine or tyrosine moieties, preferably contained in the multimeric protein or peptide using UV-activation/irradiation. In this context, UV-activation/irradiation is preferably carried out in the presence of an oxidation agent and a redox catalyst. Typically, such an oxidation agent may be selected from e.g. ammonium peroxodisulfate, etc. The oxidation agent is preferably present in a final concentration of about 5 to 15 mM, e.g. 5, 10, 15 mM, or etc. Furthermore, as a redox catalyst, preferably ruthenium-based, iridium-based or iron-based catalysts may be used, preferably comprising a bipydridyl-ligand, Even more preferably as a redox catalyst $Ru(BiPy)_2$, $Fe(BiPy)_2$, etc. may be used. The redox catalyst is preferably present in a final concentration of about 0.1 to 100 of about 0.1 to 90 µM, 0.1 to 80 0.1 to 70 µM, 0.1 to 60 µM, 0.1 to 50 µM, 0.1 to 40 µM, 0.1 to 30 µM, 0.1 to 20 or 0.1 to 10 µM, e.g. about 0.1, 1, 2, 3, 4, 5, 6, 7, 8, 9, 10, 15, 20, 25, 30, 35, 40, 45, 50, 55, 60, 65, 70, 75, 80, 85, 90, 95 or 100 µM, or etc. Redox catalyst $Ru(BiPy)_2$ is preferably used in a concentration of about 0.1 to 10 µM, e.g. 0.1, 1, 2, 3, 4, 5, 6, 7, 8, 9 or 10 µM or any range selected from two of these values. Redox catalyst $Fe(BiPy)_2$ is preferably used in a concentration of about 0.1 to 100 µM, of about 10 to 100 µM, of about 0.1 to 90 µM, 0.1 to 80 µM, 0.1 to 70 µM, 0.1 to 60 µM, 0.1 to 50 µM, 0.1 to 40 µM, e.g. 10, 15, 20, 25, 30, 35, 40, 45, 50, 55, 60, 65, 70, 75, 80, 85, 90, 95 or 100 µM.

The photoactivation and thus crosslinking may be carried out with UV-light or visible light, preferably having a wave length from about 200 to about 1200 nm, more preferably from about 200 to about 380, or from 400 to about 500 nm, or with any further UV-wavelength or visible light suitable for the inventive purpose and as known to a skilled person. Without being limited thereto, photoactivation may be carried out using an UV-lamp, e.g. an UV-lamp DeTrey Dentsply—EUROMAX Polymerization Unit—Powersupply Serial No. 21383, or a Tungsten-Halogen-lamp (300-1200 nm) Hand Oice Serial No. E467, etc.). The time of photoactivation is selected as suitable and known to a skilled person.

For crosslinking the multimeric protein or peptide structures, preferably as obtained according to the inventive method, may be used in a concentration of about 5 to 25% (w/w) or even higher with regard to the solution comprising the multimeric protein or peptide structures and the crosslinker and/or buffer. In the range lower than 5%, or even below 1% (w/w) of the protein hydrogel like materials are obtained. As a solvent organic solvents or ionic liquids know to dissolve the protein (e.g. DMSO) or buffer solutions, aqueous solutions of guanidinium chloride, or pure water, preferably any suitable solvent/buffer may be used.

According to a further aspect, the inventive method for assembling multimeric protein or peptide structures and hence the multimeric protein or peptide structures prepared thereby may be used to prepare crosslinked peptide structures as described herein.

Crosslinked multimeric protein or peptide structures, i.e. inventive peptide based polymers as defined above, are preferably ELP-like polymers, more preferably resilintype ELP-like polymers or amphiphilic ELP-like polymers. ELP-like polymers in general are preferably prepared utilizing multimeric protein or peptide structures for crosslinking comprising or consisting of a ELP-like protein sequence according to general formula (I). Resilintype ELP-like polymers are preferably prepared utilizing multimeric protein or peptide structures for crosslinking comprising or consisting of a resilintype ELP-like protein sequence according to general formula (Ia). Likewise, amphiphilic ELP-like polymers are preferably prepared utilizing multimeric protein or peptide structures for crosslinking comprising or consisting of an amphiphilic ELP-like protein sequence according to general formula (Ib) or (Ic).

Such crosslinked peptide structures as described herein exhibit advantageous properties. As an example, resiline like ELP based polymers as described herein may provide, preferably upon stepwise increase of the degree of crosslinking, a change in mechanical properties from gel-like (elasticity modulus less than 1 kPa up to several hundred MPa—corresponding to Polyurethane) to the GPa-regime to highly viscous polymers and exhibit improved mechanical properties and cell interaction potential. Such resiline like ELP based polymers as described herein may provide substitutes for cartilages, substitutes for intervertebral disks or spinal disks, knee lubricant (or as lubricant for other joints), as a heart valve or heart valve basis materials to be seeded with cells, may be used as a bladder substitute, as a skin substitute, as a substitute for the eardrum, as a stem cell niche, as 2- and 3D matrix for tissue engineering (e.g. for autologous tissue) etc. These resiline like ELP based polymers as described herein also do not exhibit immunogenic properties as ELPs are known to be non-immunogenic. Resiline like ELP based polymers as described herein may furthermore be used to provide industrially used rubbers, adhesives, etc.

ELP based polymers prepared as described herein from multimeric protein or peptide structures may also be used as thermo-, iono- and pH-sensitive switches as a in vivo or in vitro detergent or vesicle forming agent for the functional expression of membrane proteins in vivo or in vitro. As an example ELP based polymers as described herein, preferably amphiphilic ELP based polymers as described herein, may be used as protease carrier/release agents, as a detergent or cleaning agent additive. For such a purpose, the thermo-, iono- and pH-sensitive properties of a ELP based polymer, preferably of an amphiphilic ELP based polymers as described herein, may be used to switch or encase a reactive agent, e.g. a protease, such as Savinase from Novozym in its structure, and to convert its structure upon a specific external trigger, e.g. pH, temperature or ionic strength, allowing for the enzymes functional state or release the reactive agent into the surrounding. This may dispense the use of borates and perborates in cleaning processes and laundry. As a further example, ELP based polymers as described herein, preferably amphiphilic ELP based polymers but also homopolymeric ELP with defined pH, temperature or ionic strength dependent properties concerning structural changes as described herein, may be also used as a functional switch for turning the function of a protein or peptide on or off, preferably in vivo, in vitro or ex vivo. Such a protein or peptide may be but not restricted to an enzyme, a ligand or a receptor or any systemically acting switch of active molecule. For example flanking EYFP (enhanced yellow flourescing protein) with different long ELP-like polymers (1. $(VPGVG)_{20}$-EYFP-$(VPGVG)_{20}$ (SEQ ID NO: 75), 2. $(VPGVG)_{20}$-EYFP-$(VPGVG)_{40}$(SEQ ID NO: 76), 3. $(VPGVG)_{40}$-EYFP-$(VPGVG)_{40}$ (SEQ ID NO: 77)) leads to a supression of the flourescence of EYFP in dependency of the ELP-length in E. coli in vivo.

Finally, amphiphilic ELP-like polymers as described herein and other proteins described herein with amphiphilic block-structure (biobased (Protein)detergents—potential to fine tune them by genetic library means, design new materials with nanoscaled and defined inner architecture (e.g. gyroids) may be used to prepare for metamaterials, precisely controlled multi-blockcopolymer proteins to guide nanoparticle assembly and classical and non-classical crystallization and biomineralization in 2D & 3D. Further applications as technical detergent may be envisaged. So far just one protein known that can be used for this purpose (hydrophobin, used e.g. by the BASF company). Such polymers may be also used to stabilize emulsions and suspensions (e.g. Clay particles . . . ), as compartmentalized architectures with special liberation properties and adjustable kinetics in Drug Delivery including the introduction of signal proteins and targeting epitopes, for the design of specific peptide linkers for physical and chemical (covalent) drug binding, as genetically encodable subcellular organelles (impact cells developmental and synthetic capabilities), e.g. for the construction of cells with expanded functions or minmal cells, shuttling and targeting functional or cytotoxic agents in vivo and in vitro, to control, guide/support biomineralization processes and the ability to encode and locate enzymatical and chemical reactions in vivo and in vitro. In such synthetic organelles the conjugation of enzymes specifically to the inner side of the organelles may allow the production of e.g. toxic molecules in high concentration or allow the shuttling of e.g. cytostatica or antibiotics to target delivery locations in living organisms using specific naturally or synthetic cells.

FIGURES

The figures shown in the following are merely illustrative and shall describe the present invention in a further way. These figures shall not be construed to limit the present invention thereto.

FIG. 1: shows an SDS-PAGE of DNA ladders of ELP-template nucleic acids derived from de novo annealed oligonucleotides and cyclic multimerisation of the double stranded template molecules.

In the description of multimers herein the abbreviation $V_n$ indicates an n-mer of a nucleic acid fragment encoding for one pentamer encoding unit (VPG $\underline{V}$G)$_n$=(GTTCCGGGT$\underline{GTT}$GGT)$_n$. (SEQ ID NO: 78, 79), wherein in n=1 to 600, The abbreviation C indicates the codon encoding for the amino acid cysteine at the fourth pentameric position, the abbreviation F for the codon encoding for the amino acid phenylalanine at the fourth pentameric position and R for arginine at the respective position, etc. Fragment length and number of repeat units of the protein polymer encoding inserts and the corresponding cloning vectors are marked in the figure legend besides. For analytical purposes the template-multimers were excised with two suitable insert flanking restriction enzymes. FIG. 1 A. demonstrates the multimerisation of $V_n$ units within the pET28-NMCysL vector from $V_{20}$ ((VPGVG)$_{20}$) (SEQ ID NO: 80) up to $V_{100}$ ((VPGVG)$_{100}$) (SEQ ID NO: 81) pentamer units on DNA level. FIG. 1 B. shows the constructs generated in the pIB-ELPQ2 vector (variant of pIB-ELPQ). The DNA templates for $V_{20}$ ((VPGVG)$_{20}$) (SEQ ID NO: 80), $R_{20}$ ((VPGRG)$_{20}$) (SEQ ID NO: 82), $F_{20}$ ((VPGFG)$_{20}$) (SEQ ID NO: 83) and $F_{40}$ ((VPGFG)$_{40}$) (SEQ ID NO: 84)-ELP are combined with a C-terminal cysteine containing pentamer.

Figure 2:
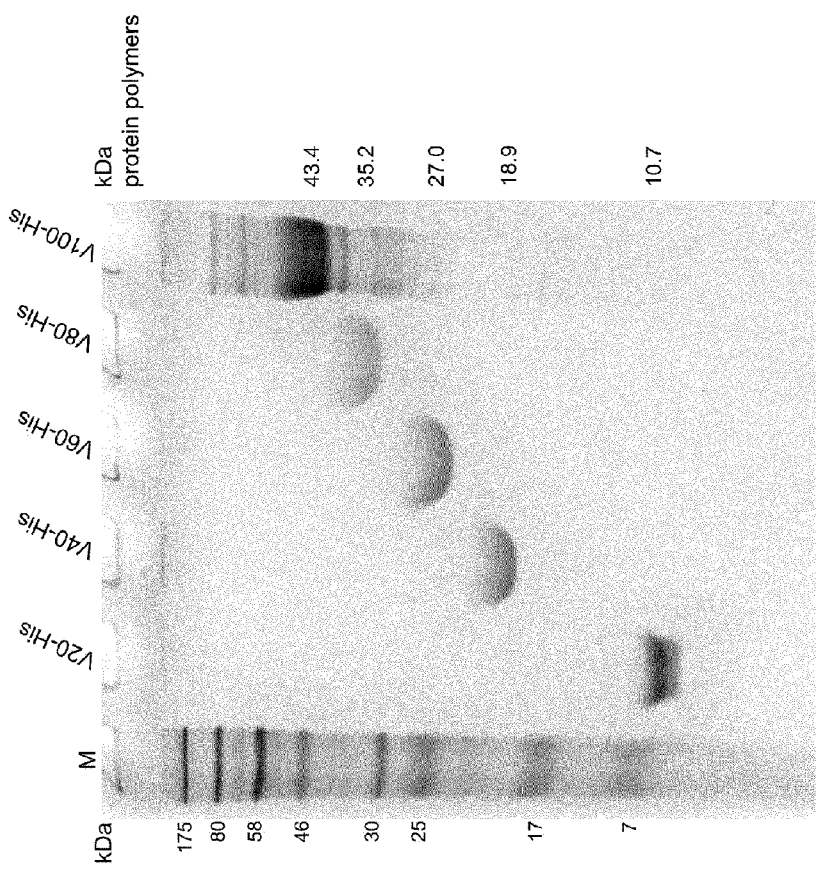

FIG. 2: shows an SDS-PAGE of a protein ladder of $V20_n$-His elastin-like proteins (ELP) (SEQ ID ID NO: 2, multiples of the V20 motiv) derived from the cyclic de novo multimerization of the double stranded template molecule. Abbreviations were used as described above for FIG. 1.

Figure 3:
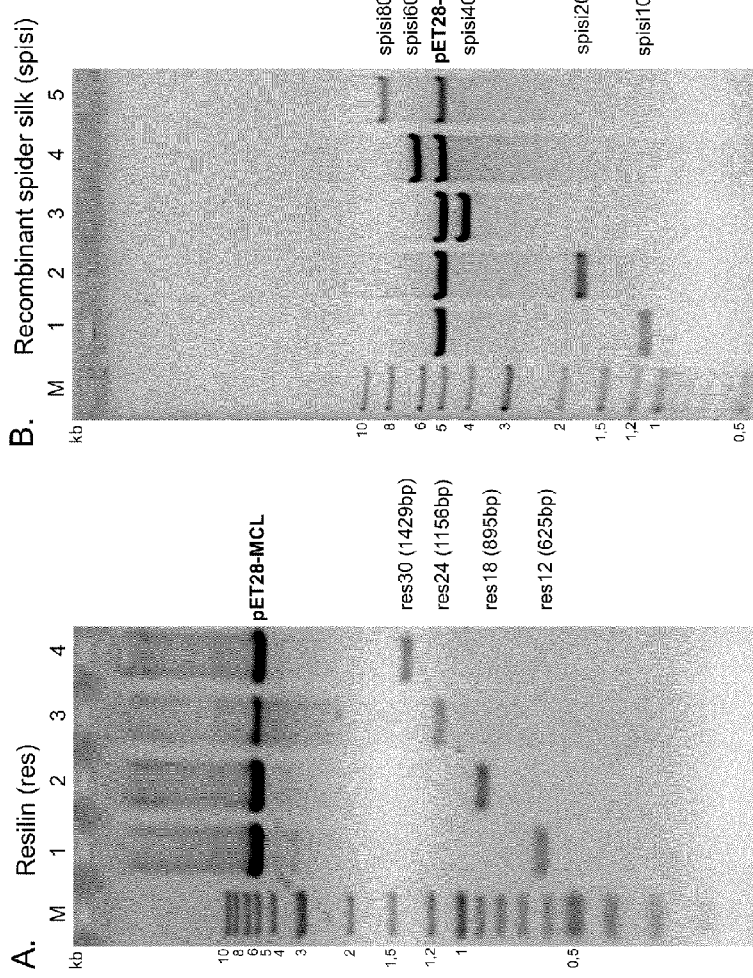

FIG. 3: shows an SDS-PAGE of DNA ladders of template nucleic acids for resilin reel protein and recombinant spider-silk protein.

Fragment length, specification and number of repeat units of the protein polymer encoding nucleic acid multimer and the corresponding cloning vectors are referred to in the figure legend besides. FIG. 3A. illustrates the multimerization products of resilin rec1 protein within the pET28-MCL vector from res12 up to res30 repeat units on DNA level. FIG. 3B. shows the recombinant spider-silk constructs generated by cyclic and directional ligation within the pET28-MCL-vector. For analytical purposes the template-multimers were excised with two suitable insert flanking restriction enzymes.

Figure 4:
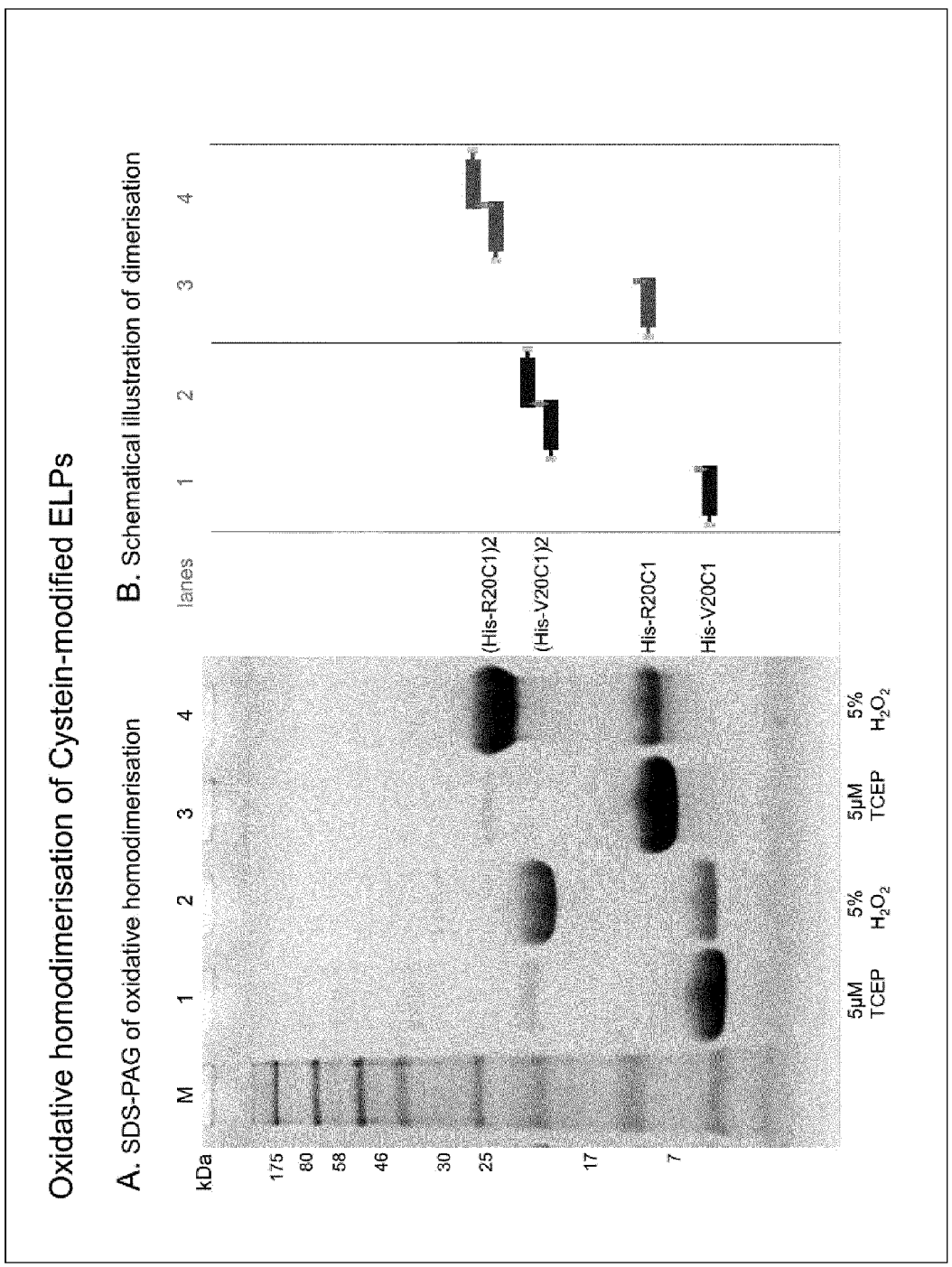

FIG. 4: shows in FIG. 4 A. an SDS-PAGE of SDS-PAG of an in vitro homodimerisation of cys containing ELP blocks (His-$V_{20}C_1$ (His-(VPGVG)$_{20}$(VPGCG)$_l$) (SEQ ID NO: 85) and His-$R_{20}C_1$ (His-(VPGRG)$_{20}$(VPGCG)$_l$)) (SEQ ID NO: 86). Lane 2 & 4 present the reaction products of the oxidative disulfide formation. Lanes 1 & 3 show the results of the same reaction supplemented with the strong reducing agent TCEP. In FIG. 4 B. the possible products were illustrated in a schematic manner.

Figure 5:
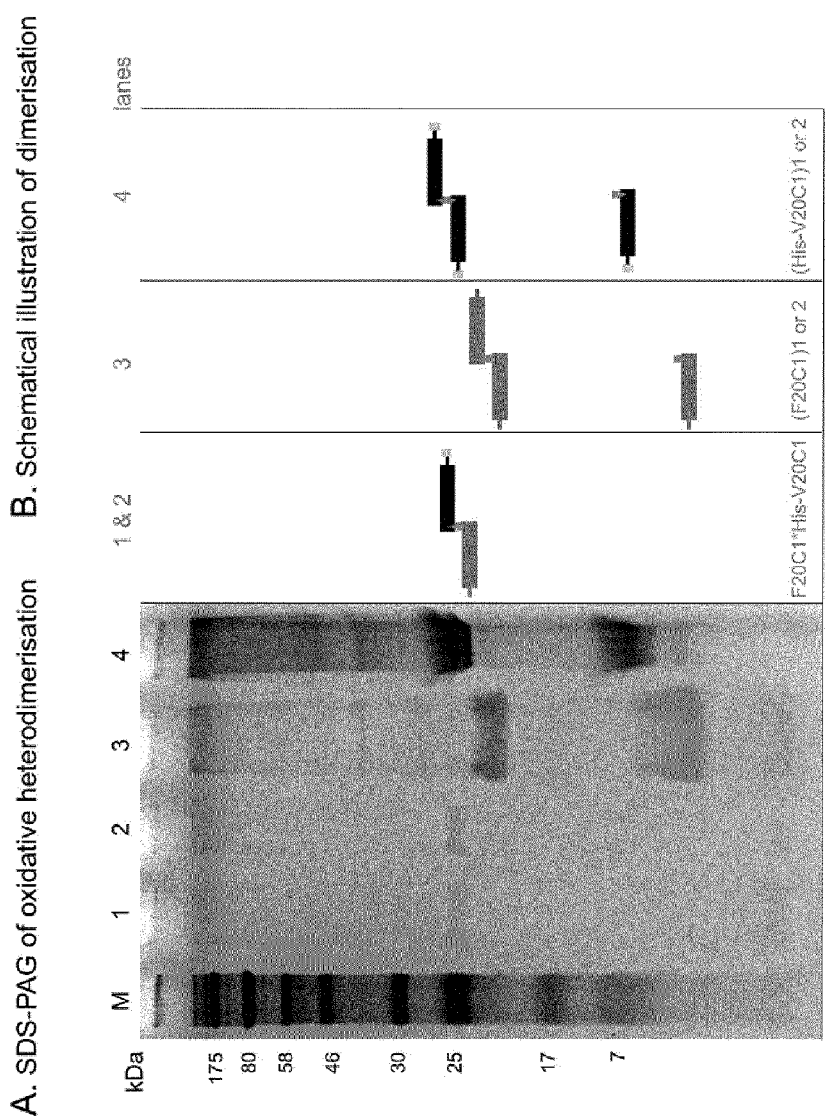

FIG. 5: A. shows an SDS-PAGE of an in vitro heterodimerisation of Cys containing ELP blocks His-$V_{20}C_1$ (His-(VPGVG)$_{20}$(VPGCG)$_l$) (SEQ ID NO: 85) and $F_{20}C_1$ ((VPGFG)$_{20}$(VPGCG)$_l$) (SEQ ID NO: 87). The $F_{20}C_1$ and His-$V_{20}C_1$ ELP were incubated together at RT for 20 hours in the presence of 10% I2/KI-solution as oxidative agent.

Under appropriate conditions (salt concentration and temperature) the His-$V_{20}C_1$ ELP monomer and homodimer could be separated from the other proteins via its Tt (temperature transition point) (see lane 4). The $F_{20}C_1$*His-$V_{20}C_1$ heterodimer could be separated from the other fraction ($F_{20}C_1$ monomer and homodimer—see lane 3) by the His-Tag of the His-$V_{20}C_1$ part (see lanes 1 & 2).

FIG. 6: shows ELP photocrosslinking within glass capillaries. As can be seen, blue fluorescence is observed after crosslinking & removal of the catalyst. The lower pictures show the crosslinked protein swollen in water (left fiber in the pictures, less swelling, still catalyst present which quenches the fluorescence; right fiber, swollen in DMSO, more swelling, catalyst removed from network, blue fluorescence).

Figure 7:
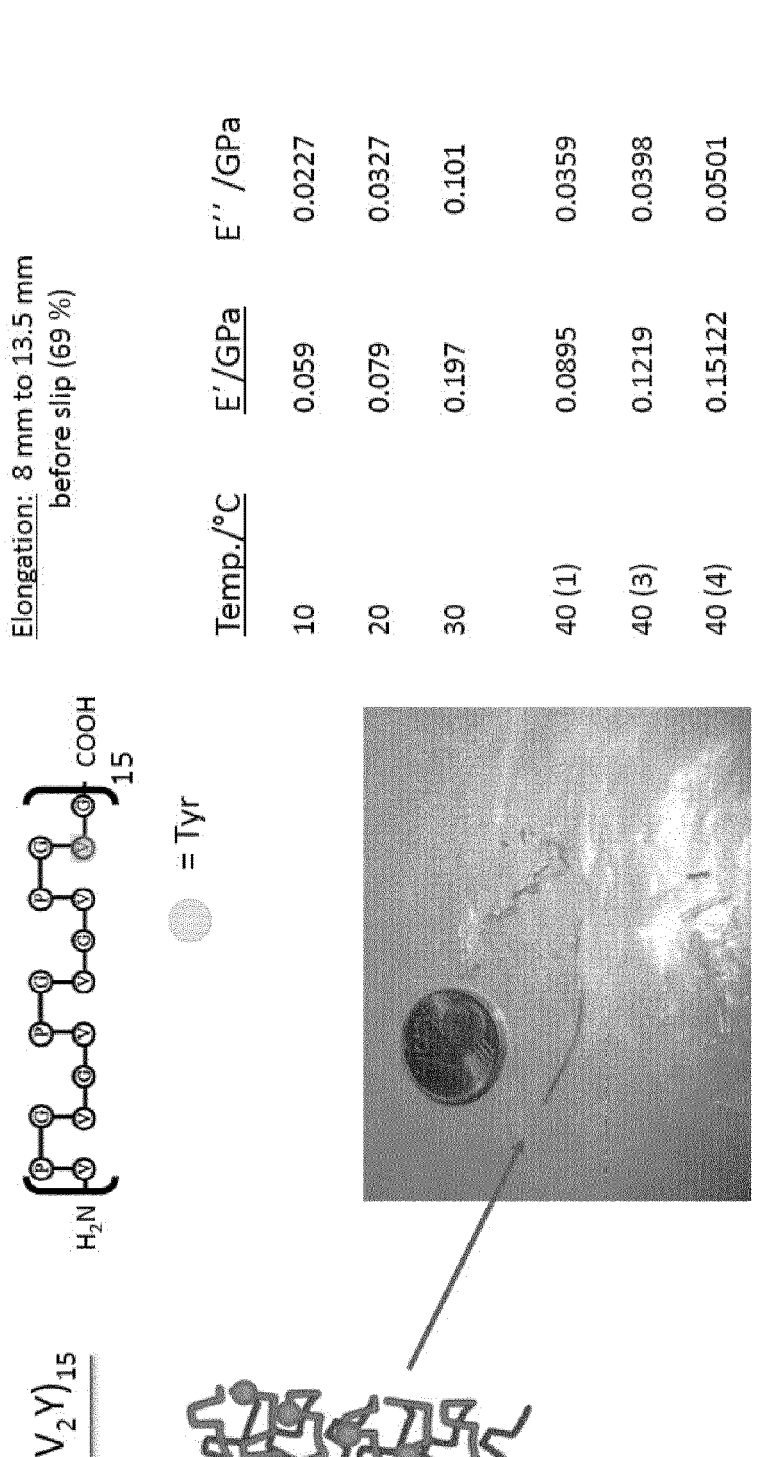

FIG. 7: shows ELP photocrosslinked. 15% large elastic modulus of several hundred MPa can be achieved—here 15% w/w protein maximum crosslink under condition presented above. To be noted is the increase in time for consecutive measurements due to dehydration.

Figure 8:
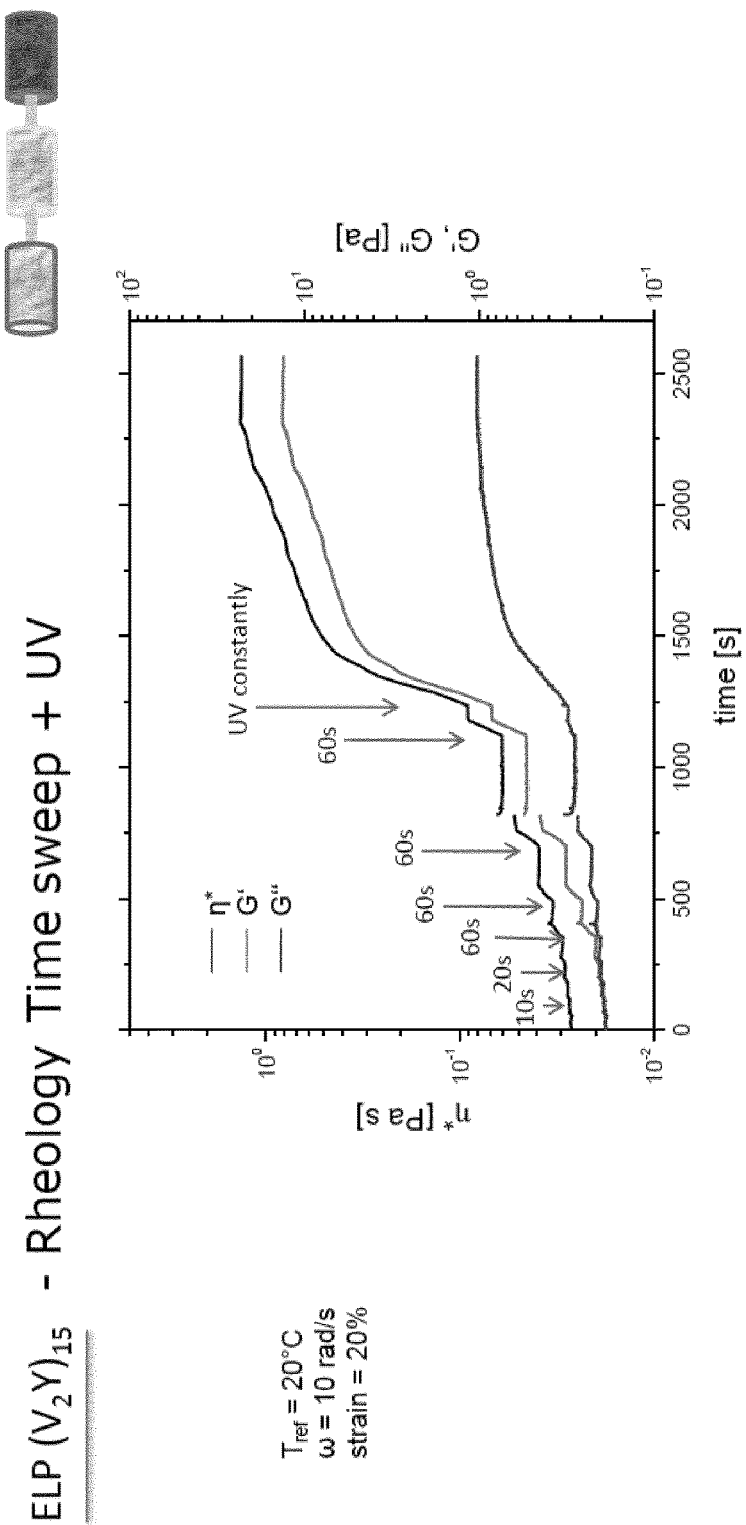

FIG. 8: highlights the important method of controlled UV-irradiation in adjusting the elasticity/viscosity of a protein preparation. It can be seen that the increase in elastic modulus only takes place while the materials is irradiated with UV-light. If the irradiation is turned off, a plateau appears immediately. Specifically, FIG. 8 shows the development of the rheological properties of a 1% protein solution during photocrosslinking (simultaneous measurements) after various time spans of UV-irradiation. The flat parts correspond to the off times indicating that no crosslinking occurs after the UV-light source is turned off. Thus the mechanical properties can be defined precisely e.g. by the irradiation time and protein concentration.

Figure 9:
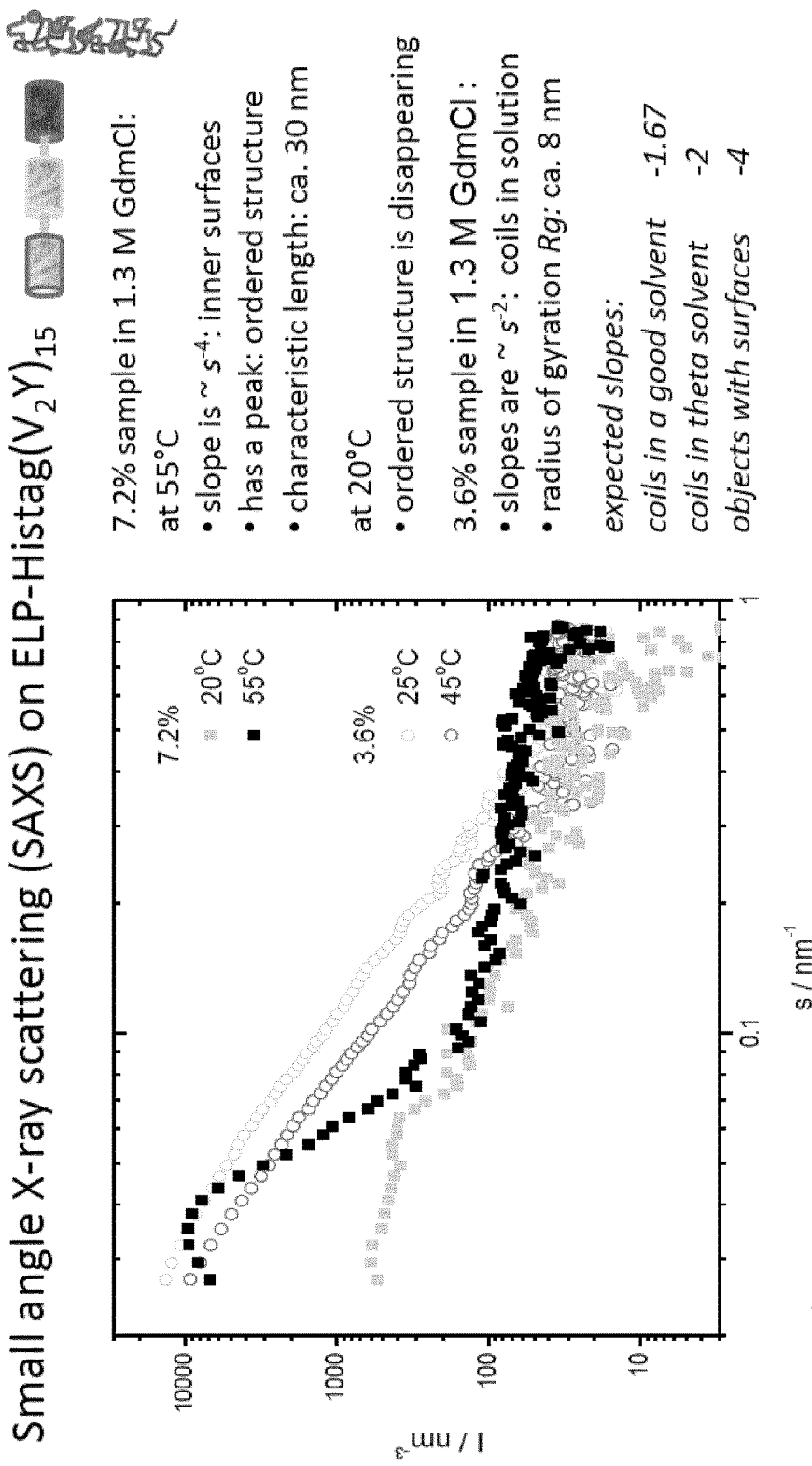

FIG. 9: shows SAXS measurements on a 7.2% and a 3.6% ELP $(V_2Y)_{15}$ ((VPGVG)$_2$(VPGYG)$_{15}$) (SEQ ID NO: 88)) solution in aqueous GdmCl solutions at various temperatures. The data shows that ELP $(V_2Y)_{15}$ undergoes a structural change with is temperature an GdmCl concentration dependant. A structure formation process can be observed which resembles cylindrical or nematic structures.

Figure 10:
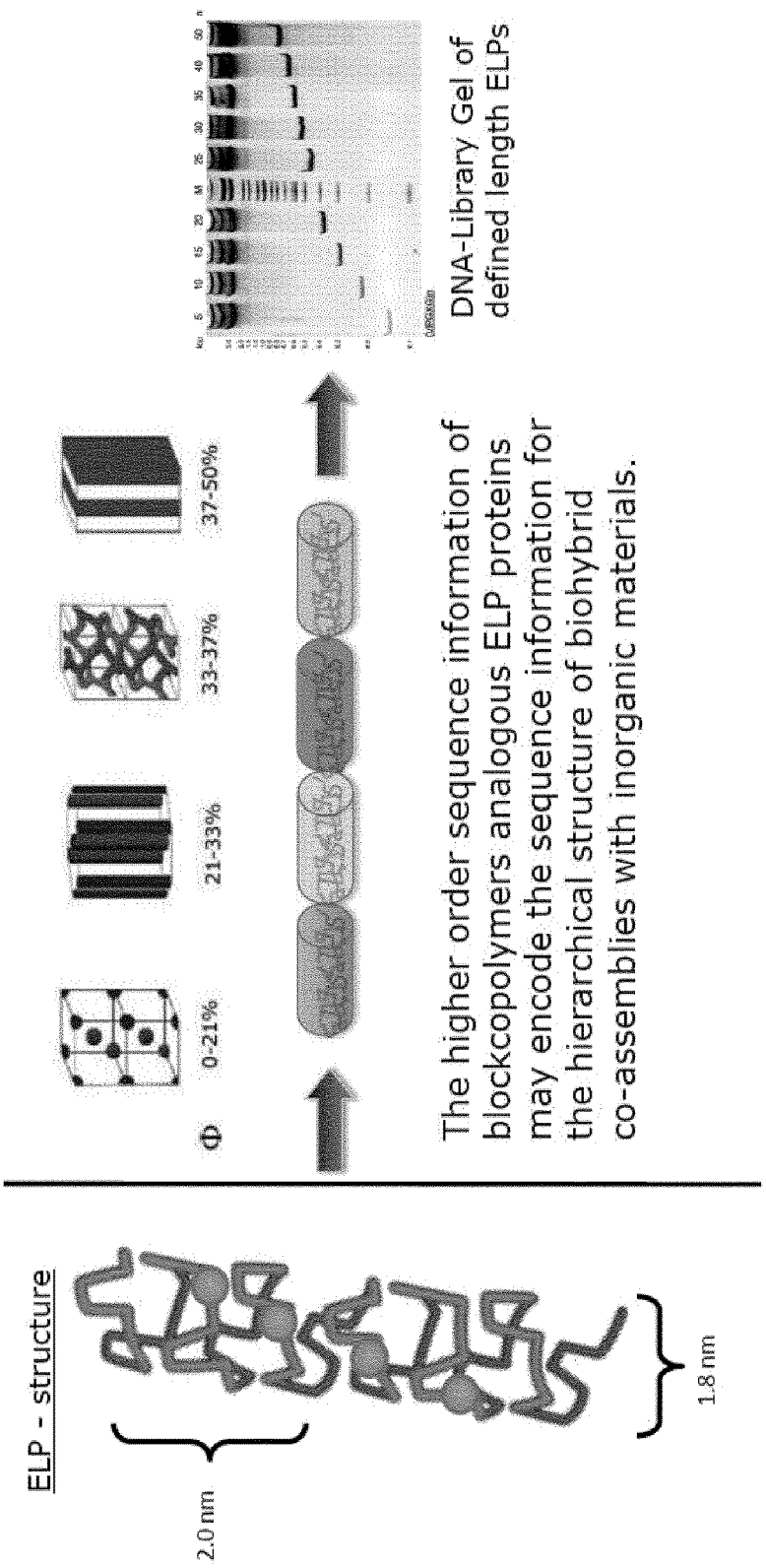

FIG. 10: illustrates the possibility to create materials with defined inner structures e.g. gyroids and lamella like phases by exact, genetically encoded blockcopolymer like protein sequences for applications in bionantechnology, e.g. in the fabrication of molecular electronics, nanomagnets and metamaterials.

Figure 12:
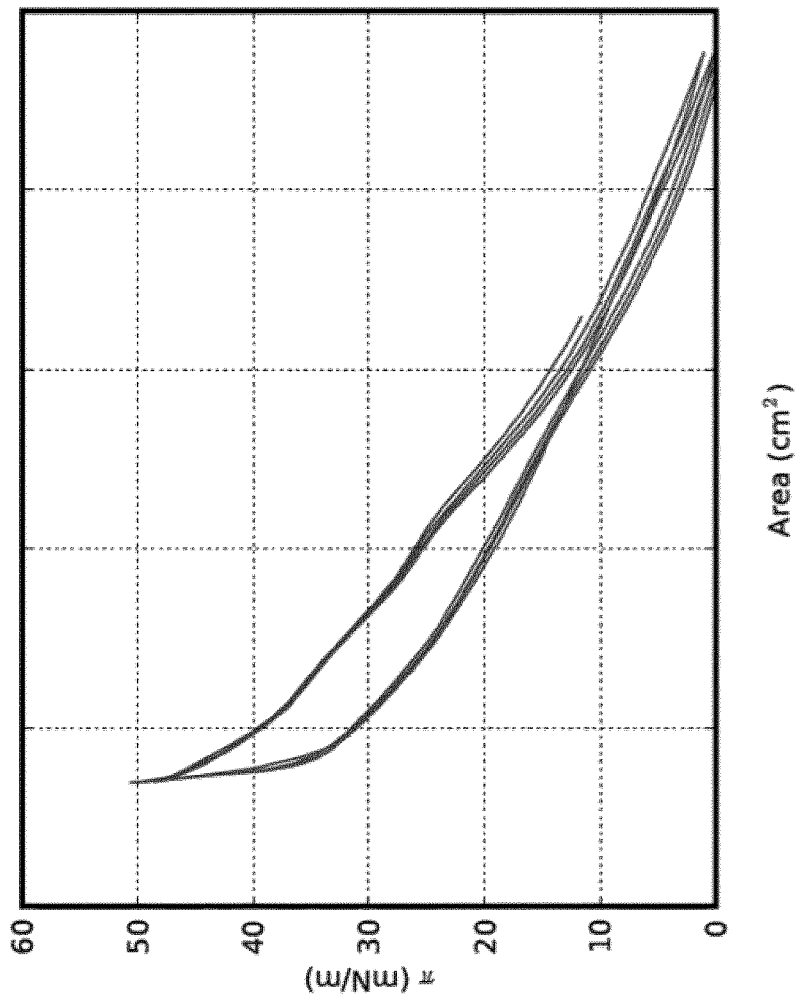

FIG. 11: shows data on amphiphilic and detergent like block-copolymer like ELPs, wherein the formation of stable lipid like monolayer films is illustrated. The isothermal line indicates the surface activity of ELP-$R_{20}F_{20}$ ((VPGRG)$_{20}$(VPGFG)$_{20}$) (SEQ ID NO: 89)) developing a stable film FIG. 12: shows data on amphiphilic and detergent like block-copolymer like ELPs, wherein the formation of stable lipid like monolyer films is illustrated. The isotherme showing the potential of ELP-$R_{20}F_{20}$ ((VPGRG)$_{20}$(VPGFG)$_{20}$) (SEQ ID NO: 89)) forming stable films, and no unspecific aggregates, since the film compresses and expands reversibly with almost no loss.

Figure 13:
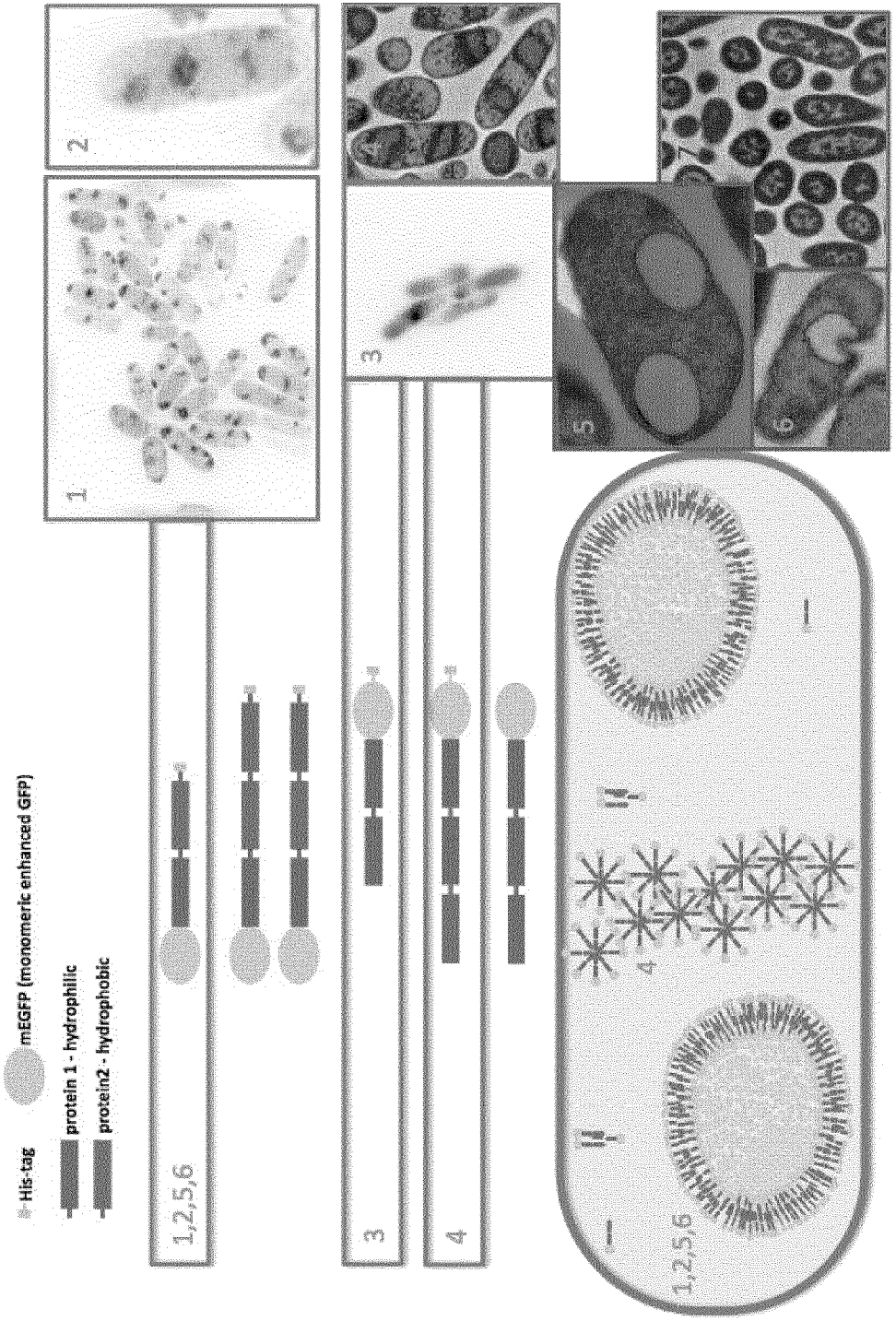

FIG. 13: show data on amphiphilic and detergent like block-copolymer like ELPs. FIG. 13 highlights the potential of various ELP constructs to form organelle like compartments within a living cell taking advantage of the fact that the expression of the ELP is genetically encoded. This allows determining the time point of organelle formation by inducing the expression of the protein. An important implication in controlling and influencing proliferation and differentiation as well as conducting specific synthetic steps within this compartment will be possible. FIG. 13 exemplarily shows different length compositions of hydrophilic and hydrophobic ELPs allow for the formation of vesicle like organelles (pictures 1,2,5,6 in FIG. 13) for ELP mEGFP-E20F20, the formation of micelles for ELP F20E40-mEGFP in picture 4, diffuse distribution of purely polar ELP-E40-mEGFP. Picture 7 shows *E. coli* cells without these ELP constructs. Pictures 1-3 in FIG. 13 are TIRF pictures, the photographs 4-7 in FIG. 13 are TEM pictures.

Figure 14:
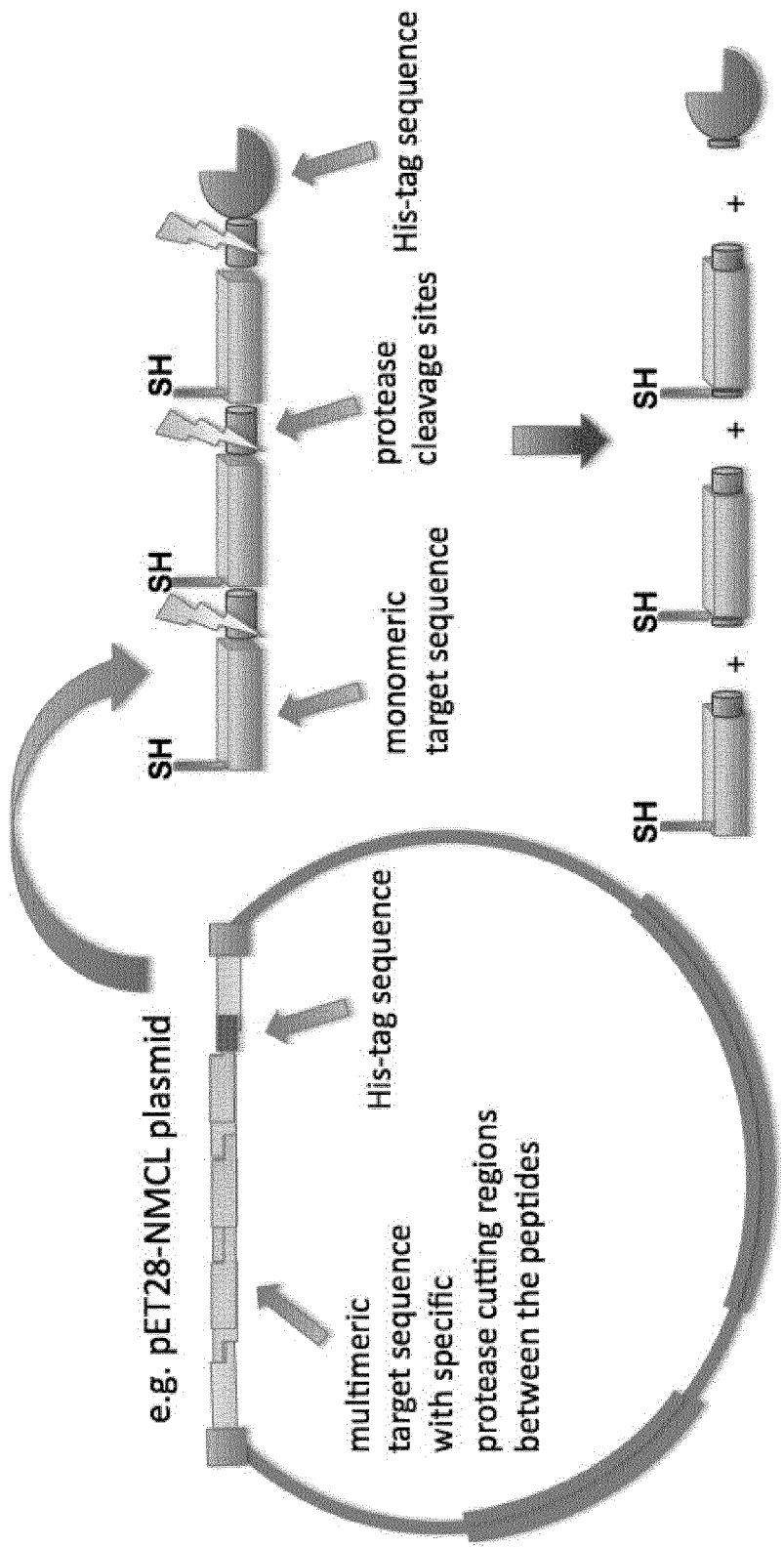

FIG. 14: shows the scheme for the scalable peptide synthesis from an oligomeric protein precursor which can be cleaved to modified or unmodified target peptides. FIG. 14 specifically shows a scheme indicating the idea of multimerizing peptide biopharmaceutical or other target sequences with a terminal purification tag; expressing the precursor protein with selective cleavage sites between each peptide target sequence. The final products can be yielded by selective digestion. The target peptides may bear an additional thiol group/Cys for surface immobilization or bioconjugation.

Figure 15:
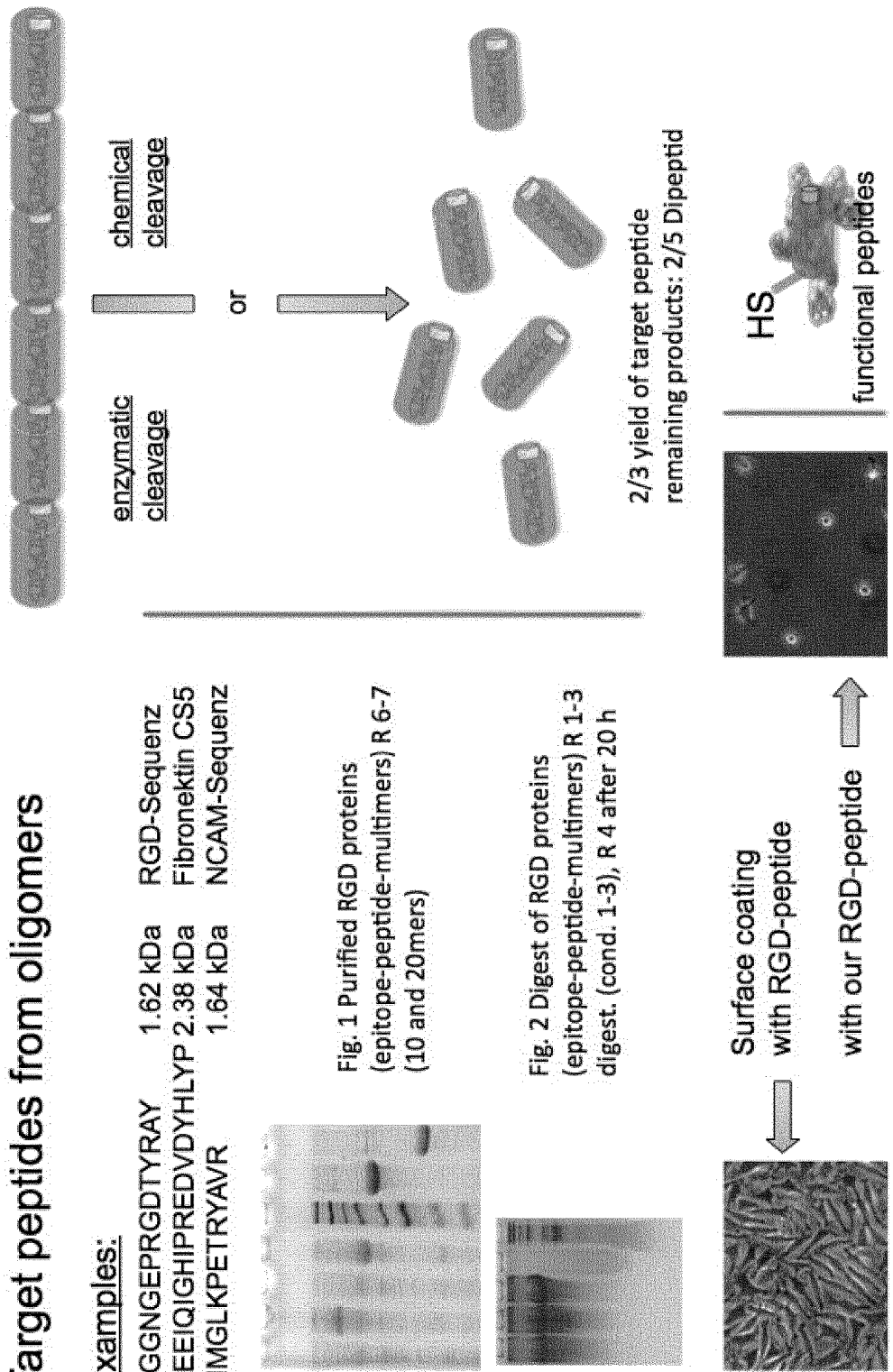

FIG. 15: shows the scheme for the scalable peptide synthesis from an oligomeric protein precursor which can be cleaved to modified or unmodified target peptides. FIG. 15 specifically shows some exemplified sequences which have been efficiently multimerized, expressed and cleaved to the corresponding peptides. As example RGD-sequence containing peptides are shown (FIG. 1 within FIG. 15 shows 10 and 20 mers with different cleavage sequences—left from the marker lane (RGD-IEGR10)$_4$ and (RGD-IEGR10)$_2$ right from the marker lane (RGDser-NG10)$_2$ and (RGDser-NG10)$_1$. Below a protein gel with different digestion conditions are shown indicating the complete digestion of the "parent"-protein.

Figure 16:
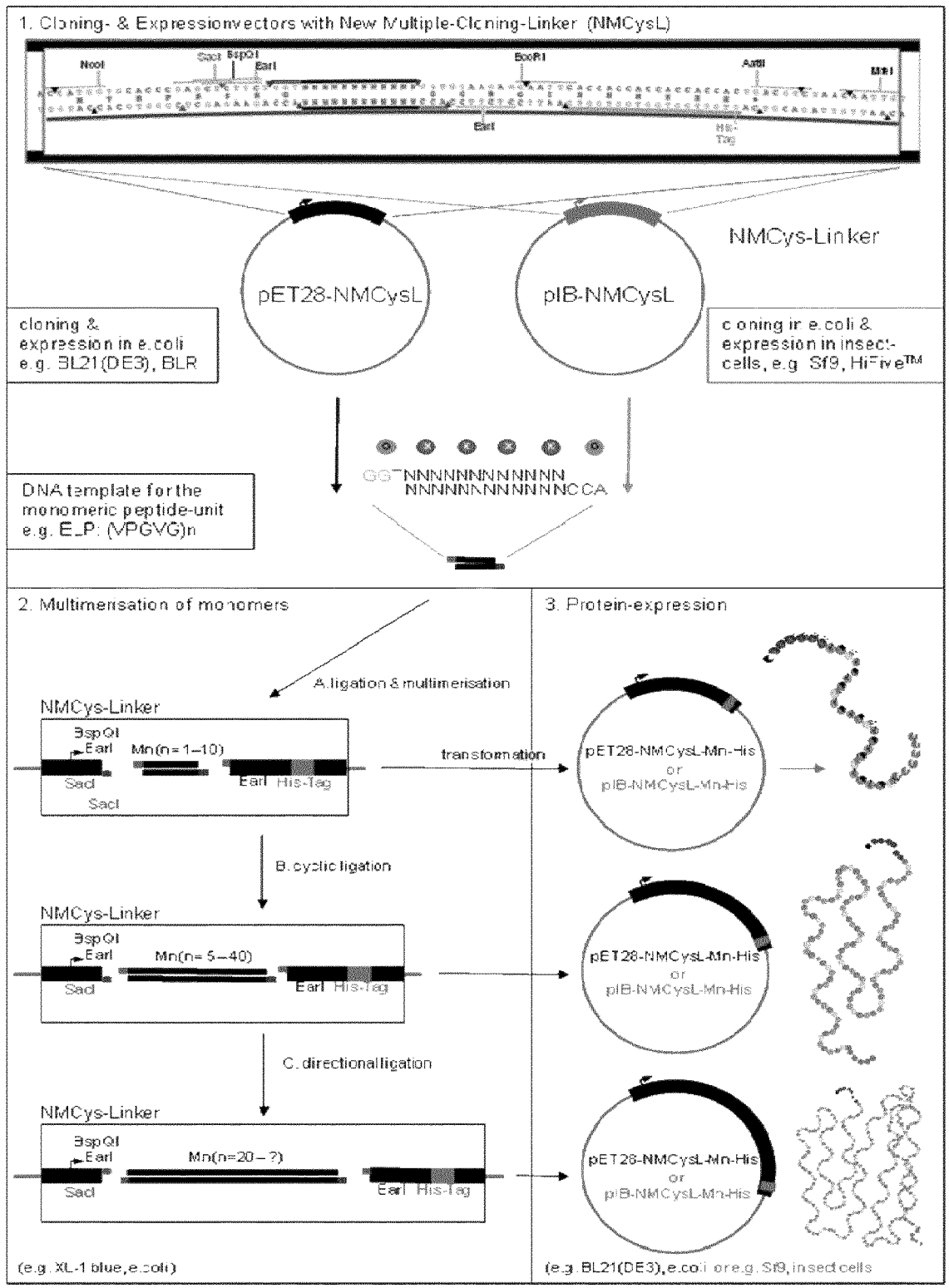

FIG. 16: shows the general scheme of preparing the constructs of the present invention, as exemplified throughout the description and as prepared or used e.g. in the examples.

Figure 17:
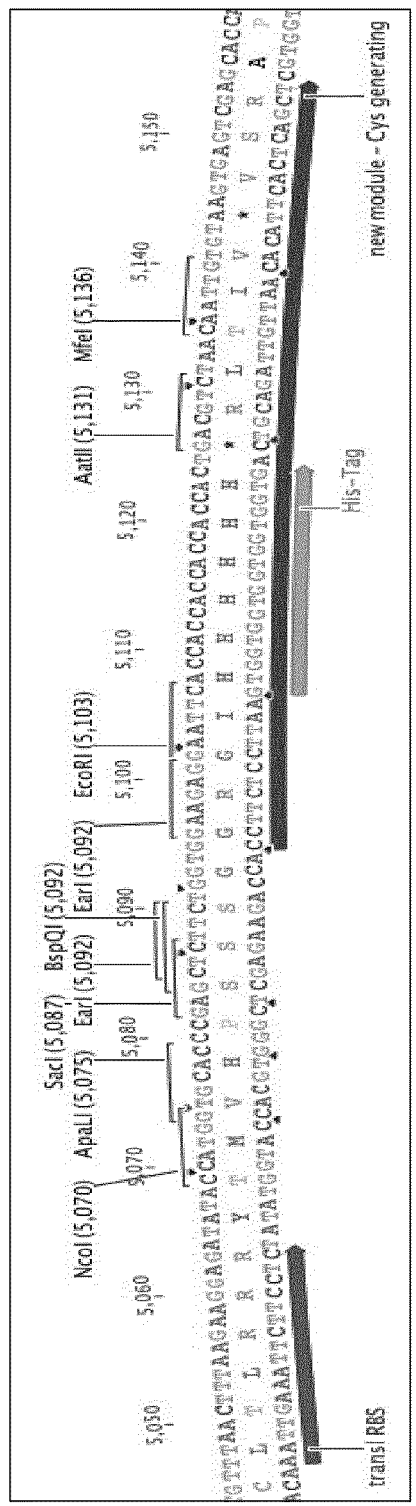

FIG. 17: depicts the pET28-NMCys-Linker region of a vector as described herein, which exemplarily illustrate the location of unique restriction sites in the inventive vector.

Figure 18:
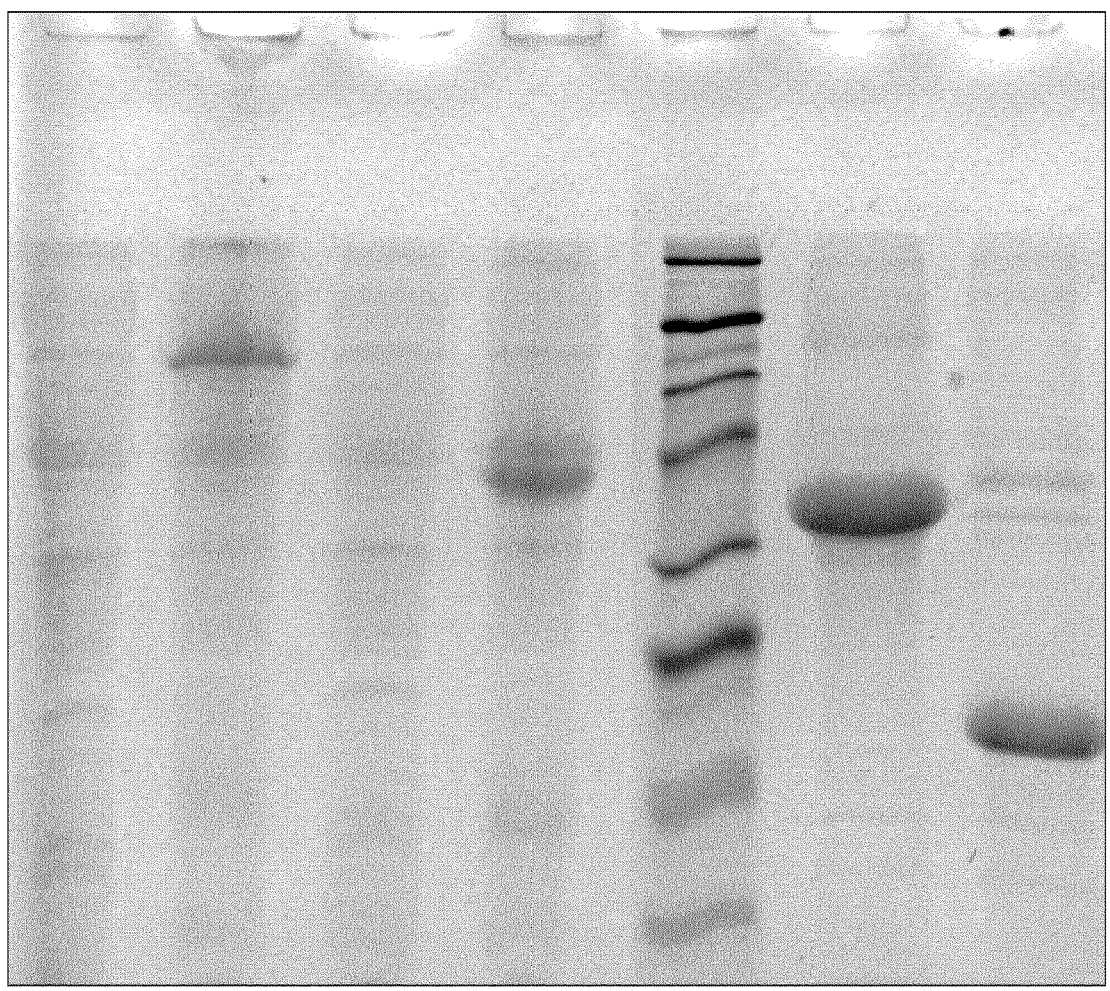

FIG. 18: shows the protein expression of (RGD-IEGR10)$_4$ and (RGD-IEGR10)$_2$ (– and + IPTG induction) were shown in lanes 1 to 4 (from left to the right). In lane 6 and 7 present the purified peptide multimers, particularly the protein extract of (RGDser-NG10)$_2$ and (RGDser-NG10)$_1$ multimeric peptide on a 15% SDS-PAGE.

Figure 19:
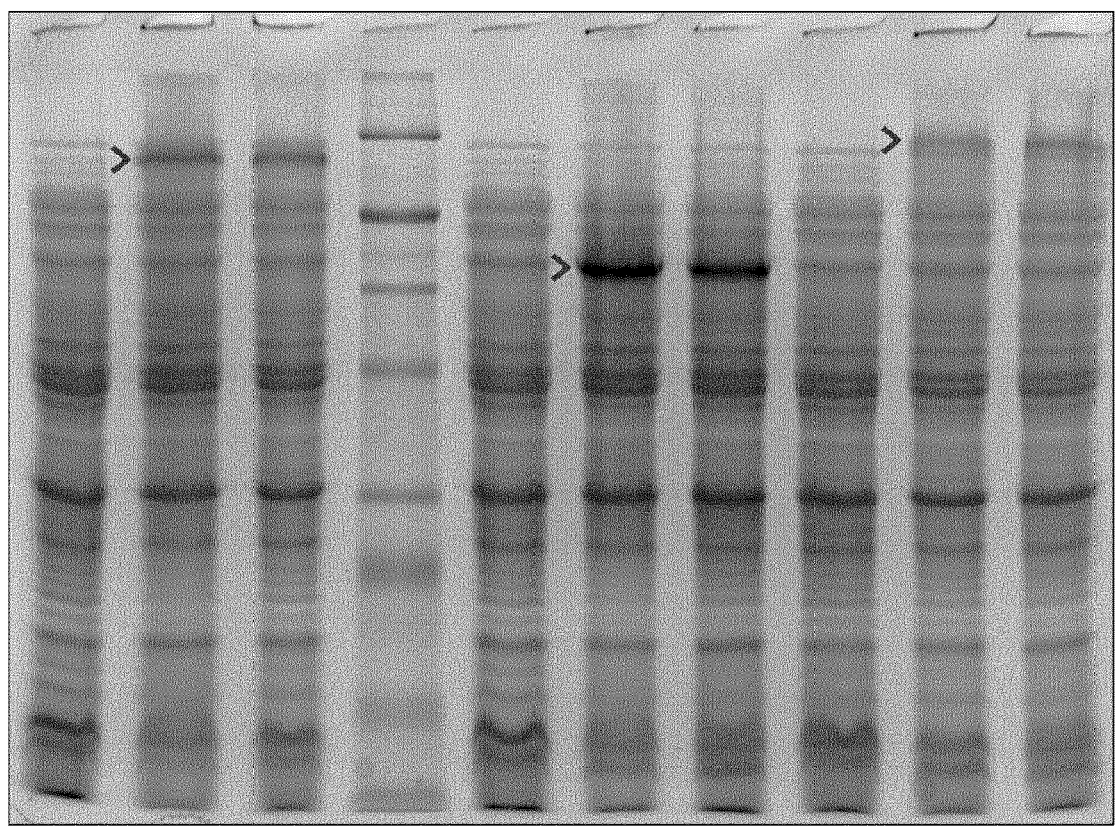

FIG. 19: shows the expression of large peptide multimers in pET28-NMCysL vector, specifically the protein expression of pET28-NMCysL(RGDser-NG10)$_8$-His (lanes 1 to 3; –/+/+ IPTG induction); pET28-NMCysL(RGD-IEGR10)$_4$-His (lanes 5 to 7; –/+/+ IPTG induction); pET28-NMCysL (fibroCS5-NG10)$_4$-His (lanes 8 to 10; –/+/+ IPTG induction) were presented (from left to right). Arrowheads mark the expressed protein.

Figure 20:
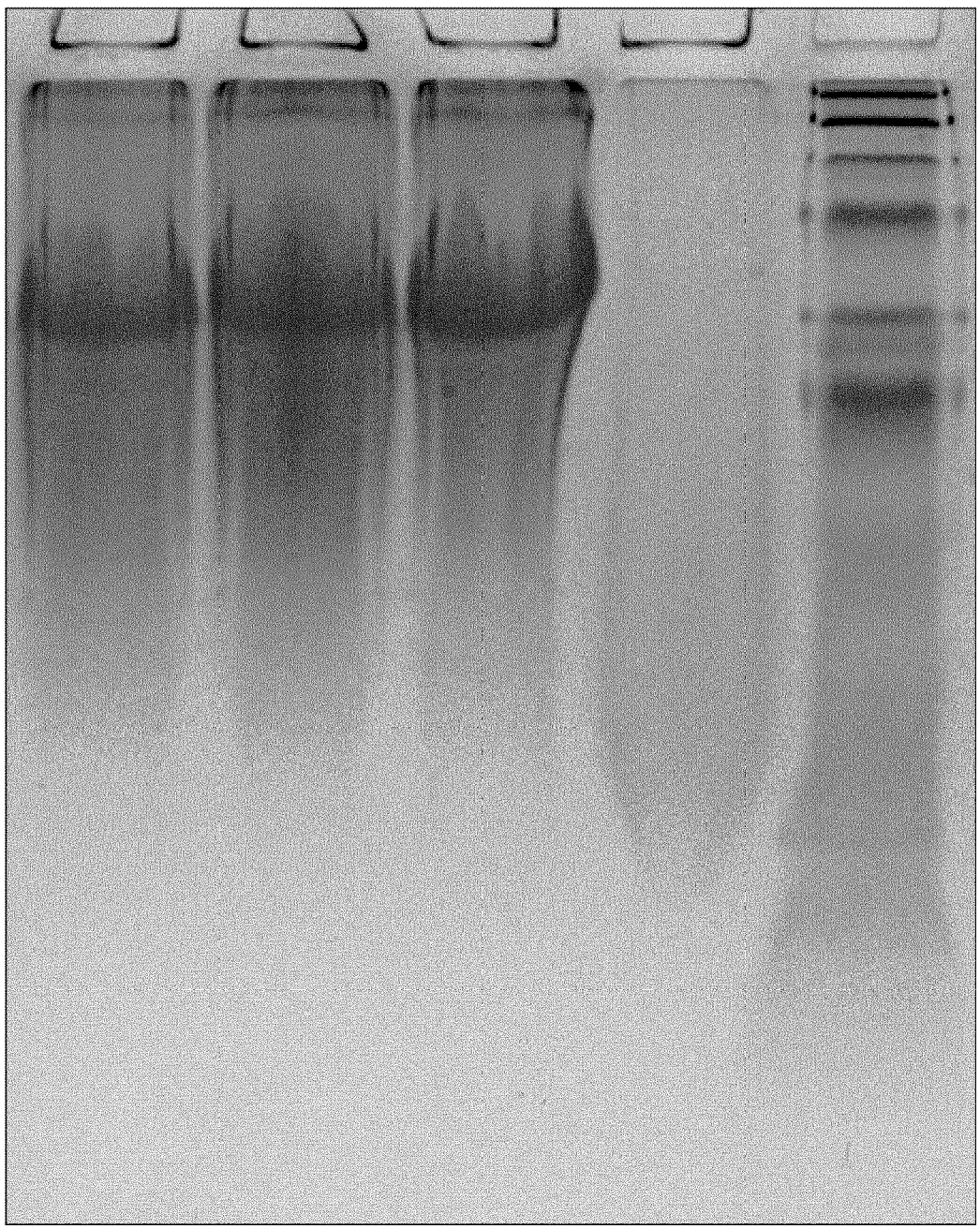

FIG. 20: shows hydroxylamine cleavage of peptide multimers. Lane 1 to 4 present different reaction conditions for hydroxylamine cleavage of (RGDser-NG10)$_2$ peptide multimer. 1: 4 h at 45°/300 rpm/pH 8.0; 2: 4 h at 45°/300 rpm/pH 8.8; 3: 20 h at 25°/300 rpm/pH 8.0 and 4: 20 h at 45°/300 rpm/pH 8.0 on a 18% SDS-PAG (from left to right).

Figure 21:
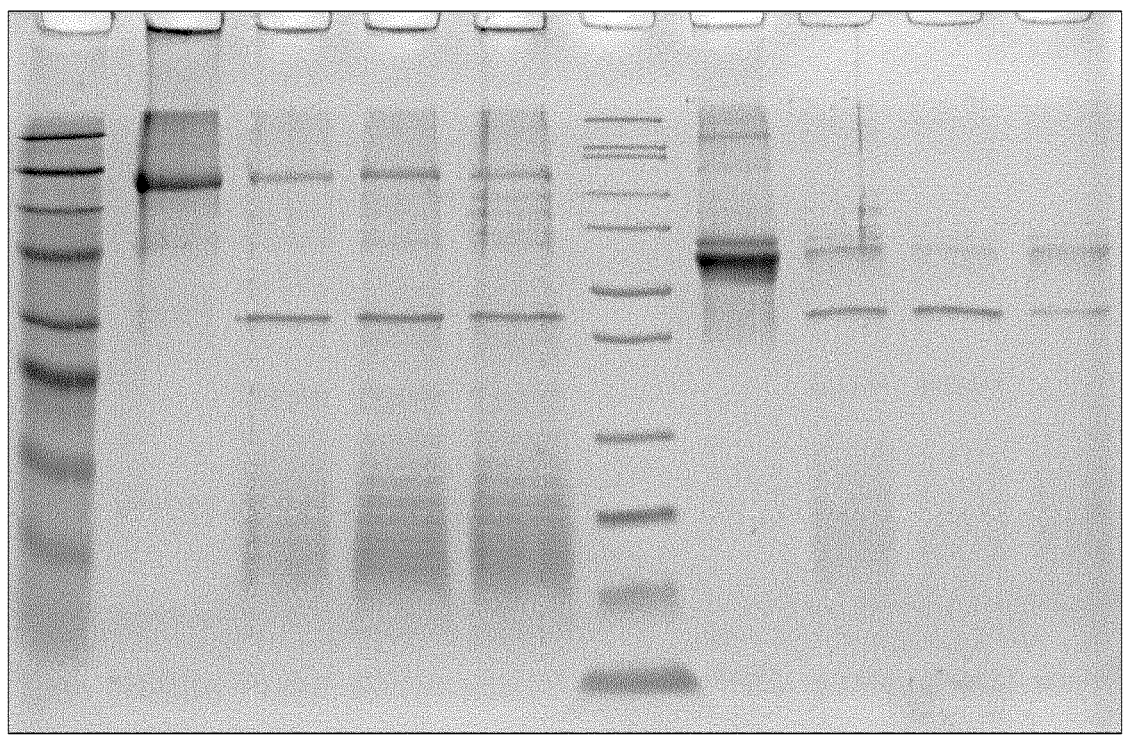

FIG. 21: shows a Faktor XA digest of peptide multimers. Lanes 2 to 5 present different reaction conditions for Faktor XA digestion of (RGDser-IEGR10)$_4$ peptide multimers. 2: 20 h at 30°/no protease; 3: 20 h at 25°; 4: 20 h at 30° and 5: 20 h at 37°. Lanes 7 to 10 present different reaction conditions for Faktor XA digestion of (RGDser-IEGR10)$_2$ peptide multimers. 7: 20 h at 30°/no protease; 8: 20 h at 25°; 9: 20 h at 30° and 10: 20 h at 37°.

EXAMPLES

The examples shown in the following are merely illustrative and shall describe the present invention in a further way. These examples shall not be construed to limit the present invention thereto.

Example 01: De Novo Synthesis of Elastin-Like Protein (ELP) Encoding Nucleic Acid Fragments De novo chemical synthesized oligonucleotides of the respective nucleic acid templates for ELP-monomers (for V template—upper strand: 5'-GGTGTTCCGGGTGTT-3' (SEQ ID NO: 90); lower strand: 5'-ACC AACACCCGGAAC-3' (SEQ ID NO: 91)) were phosphorylated, annealed and ligated into the pET28-NMCysL vector which was previously prepared by EarI digest followed by a dephosphorylation reaction (compare overview FIG. 16.1). Within this step approximately a regimen of 1 to 10 units integrate into the vector (compare overview FIG. 16.2.A). The insert length was verified by DNA sequencing and the following cyclic ligation reaction was confirmed with sequence verified V10 repeat units. By a first cyclic ligation reaction the V10 insert could be elongated up to a V40 fragment (compare overview FIG. 16.2.B). The insert was prepared by a restriction digest with EarI type II S restriction enzyme followed by gel purification. The target vector was the pET28-NMCysL-V10-His vector resulted from the first ligation reaction and digested with BspQI, dephosphorylated with CIP (calf-intestinal phosphatase) followed by gel purification. In a second round of multimerization the resulting pET28-NMCysL-V40-His vector from the first round was used as the target vector and was elongated with the EarI digested V10 insert up to pET28-NMCysL-V100-His vector (see FIG. 1.A) to generate a homopolymeric ELP-multimer.

The resulting pET28-NMCysL-V20n-His (n=1-5) vectors were transformed into *E. coli* BLR cells. *E. coli* were grown over night at 37° C. in LB-medium while shaking at 200 rpm. After IPTG induction (with f.c. 1 µM IPTG) the cells were grown for another 20 h at 20° C. Protein extraction, His-Tag purification and SDS-PAG were performed as described in Sambrook et al.: Molecular cloning: A Laboratory Manual; 3$^{rd}$ Ed. Cold Spring Harbour Laboratory Press; Cold Spring Harbour (2001). The expressed elastin-like protein multimers were shown in FIG. 2.

To supplement homopolymeric ELP-molecules (e.g. V20, R20, F20 and F40) with a functional group (e.g. amino acid cysteine which can built disulfide bridges or could be used for oxidative coupling of the protein on gold-surfaces) the respective pIB-ELPQ2-Vn/Rn/Fn cloning vectors (n=20 or 40) were used as providers (EarI digestion) for inserts to clone them into pIB-ELPQ2-C1 (Bsp: an ELP-C1 monomer=nucleic acid template coding for (VPG CG)1-pentamer)(SEQ ID NO: 127) vector. Inserts were implemented upstream to the C1 sequence motif (see FIG. 1.B). Correctness of clones was verified by sequencing and for protein expression the EarI digested inserts (Vn/Rn/FnC1) could be transferred into the pET28-NMCysL-vector.

Example 02: De Novo Synthesis of Very Large Recombinant Resilin and Spider Silk Encoding Nucleic Acid Fragments De novo chemical synthesized oligonucleotides of the respective nucleic acid templates for recombinant resilin rec1-monomers (=res1):

```
(upper strand:
                                     (SEQ ID NO: 69)
5' GGTGGTCGACCTTCTGATTCTTACGGTGCTCCTGGTGGTGG

TAAT 3';

lower strand:
                                     (SEQ ID NO: 70)
5' ACCATTACCACCACCAGGAGCACCGTAAGAATCAGAAGGTC

GACC 3'
``` were phosphorylated, annealed and ligated into the pET28-MCL vector which was previously prepared by EarI digestion followed by a dephosphorylation reaction. This vector is a precursor construct of the pET28-NMCysL vector which possesses the same constellation of the 3 unique type II (S) restriction sites in the linker region but differs in the absence of the C-terminal His-Tag. Within this first step approximately a regimen of 1 to 6 units integrate into the vector. The insert length was verified by DNA sequencing and cyclic ligation was confirmed with sequence verified res6 repeat units as described above. Target vector preparation (pET28-MCL-res6) was accomplished by BspQI digestion followed by a CIP reaction. Insert preparation was performed by EarI digestion of the same vector. Both reaction products were gel-purified for further reactions. In two rounds of cyclic ligation the resilin monomer template could be multimerised up to 30 repeat units (see FIG. 3.A).

For the de novo synthesis of nucleic acid templates for recombinant spider silk protein-monomers (=spisi1) four complementary chemically synthesized oligonucleotides of the respective sequence were phosphorylated, annealed and ligated into the pIB-ELPQ2 vector which was previously prepared by EarI digestion followed by a dephosphorylation reaction.

```
Upper strand oligo 1:
                                        (SEQ ID NO: 71)
5' GGTCGTGGTGGTCTGGGTGGTCAGGGTGCTGGTATGGCTGC

TGCTGCTGC 3';

upper strand oligo 2:
                                        (SEQ ID NO: 72)
5' TATGGGTGGTGCTGGTCAGGGTGGTTACGGTGGTCTGGGTT

CTCAGGGTACCTCT 3';

lower strand oligo 1:
                                        (SEQ ID NO: 73)
5' AGCACCACCCATAGCAGCAGCAGCAGCCATACCAGCACCCT

GACCACCCAGACCACCACG 3';

lower strand oligo 2:
                                        (SEQ ID NO: 74)
5' ACCAGAGGTACCCTGAGAACCCAGACCACCGTAACCACCCT

GACC 3';
```

After the first annealing of the complete nucleic acid template-monomer for the recombinant spider-silk a first round of cyclic ligation (as described above) leads to repeat unit numbers up to 5 units (spisi5). These fragments were sequence verified and transferred as EarI digested inserts into the pET28-MCL vector for further multimerisation and expression. With one cyclic ligation reaction (usage of spisi5 EarI fragment as insert) the construct could be multimerised up to 20 repeat units (2.2 kb). Further multimerisation must be performed with the directional ligation process (compare overview FIG. 16.2.C) because of the self-ligation and cyclisation of the large inserts with complementary ends. As target vector for further elongation the pET28-MCL-spisi20 vector was digested first with the type II S restriction enzyme BspQI followed by the digestion with the type II restriction enzyme SacI within the same reaction tube. Which results in 2 incompatible overhangs within the target vector upstream to the spisi20 sequence. For the successive doubling of the spisi20 fragment the pET28-MCL-spisi20 vector was digested first with the enzyme SacI followed by the digestion with the enzyme EarI within the same reaction tube. This generates inserts which are compatible to the target vector but can not self-ligate. Three directional ligation reactions lead to 80 repeat units of the nucleic acid template for the recombinant spider-silk protein (see FIG. 3.B).

Example 03: Oxidative Dimerisation of De Novo Synthesized Protein-Polymers

Homopolymeric ELP-molecules (e.g. V20, R20, F20 and F40) were functionalized with a C-terminal, peripherical cysteine group (see FIG. 1.B). Cysteine groups could form disulfide-bridges under oxidative conditions. Implementation of unique connectable groups (e.g. amino acids C, Y, K or W or unnatural amino acids) within artificially synthesized proteins or protein domains could be used to link them in a covalent manner.

As examples for the covalent connection of separately expressed proteins we demonstrate the oxidative homo- and heterodimerisation of different homopolymeric ELPs via disulfide-bridge formation of the respective proteins (see FIG. 4 and FIG. 5).

Example 04: Photocrosslinking of Tyrosine Protein-Polymers

ELP-molecules (e.g. ELP (V2V)15, ELP (V2Y)30) were dissolved in DMSO at concentrations of 5-20% w/w with APS 10 mM and Ru (or Fe) catalyst 0.5-1 mM (10 mM). The crosslinking is carried out with UV-light 400-500 nm using an UV-lamp. The concentration of the protein and the illumination time allow for the exact control of the elastic modulus (e.g. between several kPa and several hundred MPa to GPa) (see FIGS. 6-8).

Example 05: Synthetic Genes as Basic Constructs to Multimeric Peptides

In the following exemplary multimeric peptide sequences have been prepared on the basis of RGD-based sequences using the inventive method for multimerization as generally described above.
A. Basic Constructs for Peptide Multimers
1. Ordered Constructs The synthetic genes encoding peptides according to SEQ ID NO: 58 to 67 were ordered at Geneart GmbH (now: Invitrogene) Regensburg and other suppliers to demonstrate feasibility of the inventive concept with synthetic genes. Several suppliers were extremely expensive or not able to synthesize basic repetitive DNA sequences encoding petide multimers at the requested length and timescale.

TABLE 1

Exemplary peptide multimers

| No. | synthetic genes abbreviation | short description of the peptide/ peptide monomers | SEQ ID NO: | cleavage site/ principle |
|---|---|---|---|---|
| 1.1 | (RGDser-NG)10 | GCGGNSEPRGDTYRAYN | 58 | Hydroxylamine/ chemical |
| 1.2 | (RGD-I EGR)10 | CGGNGEPRGDTYRAYIE GR | 59 | Faktor XA/ enzymatic |
| 1.3 | (RGD-LVPR)1 | CGGNGEPRGDTYRAYLV PR | 60 | Thrombin/ enzymatic |
| 1.4 | (RGD-TEV)1 | GCGNGEPRGDTYRAYENL YFQ | 61 | TEV protease/ enzymatic |

TABLE 1-continued

Exemplary peptide multimers

| No. | synthetic genes abbreviation | short description of the peptide/ peptide monomers | SEQ ID NO: | cleavage site/ principle |
|---|---|---|---|---|
| 1.5 | (fibronectin CS5-NG)10 | GCGGGEEIQIGHIPREDV DYHLYPN | 62 | Hydroxylamine/ chemical |
| 1.6 | (NCAM-FGL-NG)10 | GCGGEVYVVAENQQGKSK AN | 63 | Hydroxylamine/ chemical |
| 1.7 | (NCAM-EncaminE-TEV)10 | GCGGTIMGLKPETRYAVR ENLYFQ | 64 | TEV protease/ enzymatic |
| 1.8 | (FDFDFDFD-NG)5 | GFDFDFDFDN | 65 | Hydroxylamine/ chemical |
| 1.9 | (GoSi-NG)5 | GAYSSGAPPMPPFN | 66 | Hydroxylamine/ chemical |
| 1.10 | (IronOx-NG)5 | GLSTVQTISPSNHN | 67 | Hydroxylamine/ chemical |

TABLE 2

Status

| No. | peptide monomer | status | expression construct in pET28-NMCysL* | peptide repeats | kDa | expression verified |
|---|---|---|---|---|---|---|
| 1.1 | GCGGNSEPR GDTYRAYN | 5 | (RGDser-NG10)1 | 10 | 20.2 | + |
|  |  | 5 | (RGDser-NG10)2 | 20 | 38.2 | + |
|  |  | 4 | (RGDser-NG10)4 | 40 | 74.2 | + |
|  |  | 4 | (RGDser-NG10)8 | 80 | 146.2 | + |
|  |  | 3 | (RGDser-NG10)10 | 100 |  |  |
| 1.2 | CGGNGEPRG DTYRAYIEGR | 5 | (RGD-IEGR10)1 | 10 | 22.7 | + |
|  |  | 5 | (RGD-IEGR10)2 | 20 | 43.3 | + |
|  |  | 5 | (RGD-IEGR10)4 | 40 | 84.4 | + |
|  |  | 3 | (RGD-IEGR10)5 | 50 |  |  |
| 1.3 | CGGNGEPRG DTYRAYLVPR | 2 | (RGD-LVPR)1 | 1 |  |  |
| 1.4 | GCGNGEPRG DTYRAYENLYFQ | 2 | (RGD-TEV)1 | 1 |  |  |
| 1.5 | GCGGGEEIQ IGHIPREDV DYHLYPN | 4 | (fibroCS5-NG10)1 | 10 | 29.8 | + |
|  |  | 4 | (fibroCS5-NG10)2 | 20 | 57.3 | + |
|  |  | 4 | (fibroCS5-NG10)4 | 40 | 112.3 | + |
|  |  | 3 | (fibroCS5-NG10)5 | 50 |  |  |
| 1.6 | GCGGEVYVV AENQQGKSK AN | 2 | (NCAM-FGL-NG10)1 | 10 | 22.2 | + |
| 1.7 | GCGGTIMGL KPETRYAVR ENLYFQ | 0 | (NCAM-encam-TEV10)1 | 10 |  |  |
| 1.8 | GFDFDFDFD N | 2 | (FDFDFDFD-NG5)1 | 5 | 8.1 | + |
| 1.9 | GAYSSGAPP MPPFN | 0 | (GoSi-NG5)1 | 1 |  |  |
| 1.10 | GLSTVQTIS PSNHN | 1 | (IronOx-NG5)1 | 1 |  |  |

Status: 0-ordered, but not delivered because of synthesis problems of supplier
1 - ordered, received and cloned into pET28-NMCysL expression vector
2 - in process of multimerisation
3 - multimerised in pET28-NMCysL vector to higher order polymers and sequence verified
4 - transformation in expression cells, protein expression and purification
5 - cleavage of multimers with proteolytic substance, analysis
*All constructs were cloned into pET28-NMCysL expression vector that allows expression and further polymerisation to higher order polymers by flanking restriction sites provided in the newly developed NMCys Linker region.

B. Cloning, Multimerisation and Expression of Peptide Multimers

The delivered synthetic genes were cloned into the herein described and newly developed pET28-NMCysL expression and cloning vector.

Therefore the EarI recognition sequences in the vector backbone were removed and a special Linker region (NM-Cys) was integrated to allow an efficient multimerisation of the repetitive multimeric peptide DNA template sequences within this vector (see FIG. 17, showing the pET28-NMCys-Linker region). The peptide multimer DNA template could be integrated and multimerised via compatible overhangs generated by EarI/BspQI cleavage.

At each step of multimerisation (see Table 2) the expression ability and expression level of the produced multimer could be tested. Successful expression of the multimerised peptide templates were marked with (+) in Table 2 (see also FIGS. 18 and 19).

C. Hydroxylamine Cleavage of (RGDser-NG10)$_2$ Multipetides to Peptides

As an example for chemical hydroxylamine cleavage of peptide multimers we use so far the (RGDser-NG10)$_1$ and (RGDser-NG10)$_2$ multimers The conditions for the proteolytic reactions were the following:

(RGDser-NG10)$_2$ peptide multimeres (10 µl with 50 µg) were supplemented with 40 µl of hydroxylamine cleavage-buffer (2 M H$_3$HNO$_3$—HCl, 0.2 M Tris-HCl pH 8.0, 6.4 M GuHCl) to a final volume of 50 µl.

The reaction was incubated for different periods of time at 45° C., shaking with 300 rpm. As a control we used a repetitive elastin like protein: (V2Y1)$_{30}$ (39.7 kDa) with comparable molecular weight that displays no hydroxylamine recognition sequence.

Under these conditions the protein (RGDser-NG10)2 (II.) was cleaved with H3NO-HCl (hydroxylamine) to the monomeric peptide RGDser-NG (I.) and multimers of these (see FIG. 20).

I. RGDser-NG Monomeric Amino Acid Sequence (SEQ ID NO: 58)
GCGGNSEPRGDTYRAYN

II. (RGDser-NG10)2 Multimeric Amino Acid Sequence (SEQ ID NO: 68)
MVHPSSSGCGGNSEPRGDTYRAYN*GCGGNSEPRGDTYRAYN*GCG

GNSEPRGDTYRAYN*GCGGNSEPRGDTYRAYN*GCGGNSEPRGDTY

RAYN*GCGGNSEPRGDTYRAYN*GCGGNSEPRGDTYRAYN*GCGGNS

EPRGDTYRAYN*GCGGNSEPRGDTYRAYN*GCGGNSEPRGDTYRAY

N*GCGGNSEPRGDTYRAYN*GCGGNSEPRGDTYRAYN*GCGGNSEPR

GDTYRAYN*GCGGNSEPRGDTYRAYN*GCGGNSEPRGDTYRAYN*GC

GGNSEPRGDTYRAYN*GCGGNSEPRGDTYRAYN*GCGGNSEPRGDT

YRAYN*GCGGNSEPRGDTYRAYN*GCGGNSEPRGDTYRAYN*GGRGI

LEHHHHHH

The resulting peptides after hydroxylamine cleavage are marked by different colored blocks. The protein (RGDser-NG10)2 (B.) should be cleaved with H3NO-HCl (hydroxylamine) to the monomeric peptide RGDser-NG (A.)

D. Proteolytic Digest of (RGD-IEGR10)2 (RGDser-NG10)4 Multiptides with Factor XA As an example for enzymatical Faktor XA digest of peptide multimers the (RGD-IEGR10)$_2$ and (RGD-IEGR10)$_4$ multimers were used.

The conditions for the enzymatic digest with Factor XA protease were the following. (RGDser-IEGR10)2 and 4 peptide multimers (25 μg) were resuspended in 29.5 μl in 1×Faktor XA reaction-buffer (20 mM Tris-HCl pH 6.8, 50 mM NaCl, 1 mM CaCl$_2$). One unit of Factor XA (0.5 μl) was added to the reaction to a final volume of 30 μl.

The reaction was incubated for different periods of time at different temperatures (25° C., 30° C., 37° C.). As a control we used a repetitive elastin like protein: (V$_2$Y$_1$)30 (39.7 kDa) with comparable molecular weight that displays no Factor XA recognition sequence. Results of the Faktor XA cleavage reaction are presented in FIG. 5.

E. Expression, Purification and Quantification of Peptide Multimers

Some of the cloned and expressed peptide multimers were so far expressed, purified and an average amount of protein per liter culture volume was quantified (see Table 3).

TABLE 3

Quantification of peptide expression

| peptide multimers | concentration (mg/ml) mg protein/ml culture | average amount of protein(mg)/L culture |
|---|---|---|
| (RGDser-NG10)1 | 0.41 | 412 |
| (RGDser-NG10)2 | 0.54 | 531 |
| (RGD-IEGR10)2 | 0.14 | 139 |
| (RGD-IEGR10)4 | 0.08 | 76 |

Annex:

The Annex shows sequences and sequence constructs exemplarily used and prepared and shall describe the present invention in a further way. These annex shall not be construed to limit the present invention thereto.

1. Exemplary Structural & Functional Macromolecular Protein Polymers Prepared According to the Present Invention:
1.1 Protein-Polymers (Based on Elastin-Like Protein (ELP) Sequences)
1.1.1 Homogeneous Protein-Polymers
1.1.1.1 ELP-V20-his (10.7 kDa)

DNA-sequence
(SEQ ID NO: 1)
ATGACTGCAGGGAGCTCTTCTGGTGTTCCGGGTGTTGGTGTTCCGGGTG

TTGGTGTTCCGGGTGTTGGTGTTCCGGGTGTTGGTGTTCCGGGTGTTGG

TGTTCCGGGTGTTGGTGTTCCGGGTGTTGGTGTTCCGGGTGTTGGTGTT

CCGGGTGTTGGTGTTCCGGGTGTTGGTGTTCCGGGTGTTGGTGTTCCGG

GTGTTGGTGTTCCGGGTGTTGGTGTTCCGGGTGTTGGTGTTCCGGGTGT

TGGTGTTCCGGGTGTTGGTGTTCCGGGTGTTGGTGTTCCGGGTGTTGGT

GTTCCGGGTGTTGGTGTTCCGGGTGTTGGTGGAAGAGAAGCTTGGATCC

TCGAGCACCACCACCACCACCAC protein sequence
(SEQ ID NO: 2)
MTAGSSSGVPGVGVPGVGVPGVGVPGVGVPGVGVPGVGVPGVGVPGVGV

PGVGVPGVGVPGVGVPGVGVPGVGVPGVGVPGVGVPGVGVPGVGVPGVG

VPGVGVPGVGGREAWILEHHHHHH

1.1.1.2 ELP-V100-His (43.4 kDa)

DNA-sequence
(SEQ ID NO: 3)
ATGACTGCAGGGAGCTCTTCTGGTGTTCCGGGTGTTGGTGTTCCGGGTG

TTGGTGTTCCGGGTGTTGGTGTTCCGGGTGTTGGTGTTCCGGGTGTTGG

TGTTCCGGGTGTTGGTGTTCCGGGTGTTGGTGTTCCGGGTGTTGGTGTT

CCGGGTGTTGGTGTTCCGGGTGTTGGTGTTCCGGGTGTTGGTGTTCCGG

GTGTTGGTGTTCCGGGTGTTGGTGTTCCGGGTGTTGGTGTTCCGGGTGT

TGGTGTTCCGGGTGTTGGTGTTCCGGGTGTTGGTGTTCCGGGTGTTGGT

GTTCCGGGTGTTGGTGTTCCGGGTGTTGGTGTTCCGGGTGTTGGTGTTC

CGGGTGTTGGTGTTCCGGGTGTTGGTGTTCCGGGTGTTGGTGTTCCGGG

TGTTGGTGTTCCGGGTGTTGGTGTTCCGGGTGTTGGTGTTCCGGGTGTT

GGTGTTCCGGGTGTTGGTGTTCCGGGTGTTGGTGTTCCGGGTGTTGGTG

TTCCGGGTGTTGGTGTTCCGGGTGTTGGTGTTCCGGGTGTTGGTGTTCC

GGGTGTTGGTGTTCCGGGTGTTGGTGTTCCGGGTGTTGGTGTTCCGGGT

GTTGGTGTTCCGGGTGTTGGTGTTCCGGGTGTTGGTGTTCCGGGTGTTG

GTGTTCCGGGTGTTGGTGTTCCGGGTGTTGGTGTTCCGGGTGTTGGTGT

TCCGGGTGTTGGTGTTCCGGGTGTTGGTGTTCCGGGTGTTGGTGTTCCG

GGTGTTGGTGTTCCGGGTGTTGGTGTTCCGGGTGTTGGTGTTCCGGGTG

TTGGTGTTCCGGGTGTTGGTGTTCCGGGTGTTGGTGTTCCGGGTGTTGG

TGTTCCGGGTGTTGGTGTTCCGGGTGTTGGTGTTCCGGGTGTTGGTGTT

-continued
```
CCGGGTGTTGGTGTTCCGGGTGTTGGTGTTCCGGGTGTTGGTGTTCCGG
GTGTTGGTGTTCCGGGTGTTGGTGTTCCGGGTGTTGGTGTTCCGGGTGT
TGGTGTTCCGGGTGTTGGTGTTCCGGGTGTTGGTGTTCCGGGTGTTGGT
GTTCCGGGTGTTGGTGTTCCGGGTGTTGGTGTTCCGGGTGTTGGTGTTC
CGGGTGTTGGTGTTCCGGGTGTTGGTGTTCCGGGTGTTGGTGTTCCGGG
TGTTGGTGTTCCGGGTGTTGGTGTTCCGGGTGTTGGTGTTCCGGGTGTT
GGTGTTCCGGGTGTTGGTGTTCCGGGTGTTGGTGTTCCGGGTGTTGGTG
TTCCGGGTGTTGGTGTTCCGGGTGTTGGTGTTCCGGGTGTTGGTGTTCC
GGGTGTTGGTGTTCCGGGTGTTGGTGTTCCGGGTGTTGGTGTTCCGGGT
GTTGGTGTTCCGGGTGTTGGTGTTCCGGGTGTTGGTGTTCCGGGTGTTG
GTGTTCCGGGTGTTGGTGTTCCGGGTGTTGGTGTTCCGGGTGTTGGTGT
TCCGGGTGTTGGTGTTCCGGGTGTTGGTGTTCCGGGTGTTGGTGTTCCG
GGTGTTGGTGTTCCGGGTGTTGGTGTTCCGGGTGTTGGTGTTCCGGGTG
TTGGTGGAAGAGAAGCTTGGATCCTCGAGCACCACCACCACCACCAC
```
protein sequence
(SEQ ID NO: 4)
MTAGSSSGVPGVGVPGVGVPGVGVPGVGVPGVGVPGVGVPGVGVPGVGV
PGVGVPGVGVPGVGVPGVGVPGVGVPGVGVPGVGVPGVGVPGVGVPGVG
VPGVGVPGVGVPGVGVPGVGVPGVGVPGVGVPGVGVPGVGVPGVGVPGV
GVPGVGVPGVGVPGVGVPGVGVPGVGVPGVGVPGVGVPGVGVPGVGVPG
VGVPGVGVPGVGVPGVGVPGVGVPGVGVPGVGVPGVGVPGVGVPGVGVP
GVGVPGVGVPGVGVPGVGVPGVGVPGVGVPGVGVPGVGVPGVGVPGVGV
PGVGVPGVGVPGVGVPGVGVPGVGVPGVGVPGVGVPGVGVPGVGVPGVG
VPGVGVPGVGVPGVGVPGVGVPGVGVPGVGVPGVGVPGVGVPGVGVPGV
GVPGVGVPGVGVPGVGVPGVGVPGVGVPGVGVPGVGVPGVGVPGVGVPG
VGVPGVGVPGVGVPGVGVPGVGVPGVGVPGVGVPGVGVPGVGVPGVGVP
GVGVPGVGVPGVGVPGVGGREAWILEHHHHHH

1.1.1.3 ELP-F20-His (11.2 kDa)

DNA-sequence
(SEQ ID NO: 5)
```
ATGGTGCACCCGAGCTCTTCTGGTGTTCCGGGTTTCGGTGTTCCGGGTT
TCGGTGTTCCGGGTTTCGGTGTTCCGGGTTTCGGTGTTCCGGGTTTCGG
TGTTCCGGGTTTCGGTGTTCCGGGTTTCGGTGTTCCGGGTTTCGGTGTT
CCGGGTTTCGGTGTTCCGGGTTTCGGTGTTCCGGGTTTCGGTGTTCCGG
GTTTCGGTGTTCCGGGTTTCGGTGTTCCGGGTTTCGGTGTTCCGGGTTT
CGGTGTTCCGGGTTTCGGTGTTCCGGGTTTCGGTGTTCCGGGTTTCGGT
GTTCCGGGTTTCGGTGTTCCGGGTTTCGGTGGAAGAGGAATTCACCACC
ACCACCACCAC
```
protein sequence
(SEQ ID NO: 6)
MVHPSSSGVPGFGVPGFGVPGFGVPGFGVPGFGVPGFGVPGFGVPGFGV
PGFGVPGFGVPGFGVPGFGVPGFGVPGFGVPGFGVPGFGVPGFGVPGFG
VPGFGVPGFGVPGFGGRGIHHHHHH

1.1.1.4 ELP-F100-His (47.8 kDa)

DNA-sequence
(SEQ ID NO: 7)
```
ATGGTGCACCCGAGCTCTTCTGGTGTTCCGGGTTTCGGTGTTCCGGGTT
TCGGTGTTCCGGGTTTCGGTGTTCCGGGTTTCGGTGTTCCGGGTTTCGG
TGTTCCGGGTTTCGGTGTTCCGGGTTTCGGTGTTCCGGGTTTCGGTGTT
CCGGGTTTCGGTGTTCCGGGTTTCGGTGTTCCGGGTTTCGGTGTTCCGG
GTTTCGGTGTTCCGGGTTTCGGTGTTCCGGGTTTCGGTGTTCCGGGTTT
CGGTGTTCCGGGTTTCGGTGTTCCGGGTTTCGGTGTTCCGGGTTTCGGT
GTTCCGGGTTTCGGTGTTCCGGGTTTCGGTGTTCCGGGTTTCGGTGTTC
CGGGTTTCGGTGTTCCGGGTTTCGGTGTTCCGGGTTTCGGTGTTCCGGG
TTTCGGTGTTCCGGGTTTCGGTGTTCCGGGTTTCGGTGTTCCGGGTTTC
GGTGTTCCGGGTTTCGGTGTTCCGGGTTTCGGTGTTCCGGGTTTCGGTG
TTCCGGGTTTCGGTGTTCCGGGTTTCGGTGTTCCGGGTTTCGGTGTTCC
GGGTTTCGGTGTTCCGGGTTTCGGTGTTCCGGGTTTCGGTGTTCCGGGT
TTCGGTGTTCCGGGTTTCGGTGTTCCGGGTTTCGGTGTTCCGGGTTTCG
GTGTTCCGGGTTTCGGTGTTCCGGGTTTCGGTGTTCCGGGTTTCGGTGT
TCCGGGTTTCGGTGTTCCGGGTTTCGGTGTTCCGGGTTTCGGTGTTCCG
GGTTTCGGTGTTCCGGGTTTCGGTGTTCCGGGTTTCGGTGTTCCGGGTT
TCGGTGTTCCGGGTTTCGGTGTTCCGGGTTTCGGTGTTCCGGGTTTCGG
TGTTCCGGGTTTCGGTGTTCCGGGTTTCGGTGTTCCGGGTTTCGGTGTT
CCGGGTTTCGGTGTTCCGGGTTTCGGTGTTCCGGGTTTCGGTGTTCCGG
GTTTCGGTGTTCCGGGTTTCGGTGTTCCGGGTTTCGGTGTTCCGGGTTT
CGGTGTTCCGGGTTTCGGTGTTCCGGGTTTCGGTGTTCCGGGTTTCGGT
GTTCCGGGTTTCGGTGTTCCGGGTTTCGGTGTTCCGGGTTTCGGTGTTC
CGGGTTTCGGTGTTCCGGGTTTCGGTGTTCCGGGTTTCGGTGTTCCGGG
TTTCGGTGTTCCGGGTTTCGGTGTTCCGGGTTTCGGTGTTCCGGGTTTC
GGTGTTCCGGGTTTCGGTGTTCCGGGTTTCGGTGTTCCGGGTTTCGGTG
TTCCGGGTTTCGGTGTTCCGGGTTTCGGTGTTCCGGGTT
TCGGTGGAAGAGGAATTCACCACCACCACCAC
```
protein sequence
(SEQ ID NO: 8)
MVHPSSSGVPGFGVPGFGVPGFGVPGFGVPGFGVPGFGVPGFGVPGFGV
PGFGVPGFGVPGFGVPGFGVPGFGVPGFGVPGFGVPGFGVPGFGVPGFG
VPGFGVPGFGVPGFGVPGFGVPGFGVPGFGVPGFGVPGFGVPGFGVPGF
GVPGFGVPGFGVPGFGVPGFGVPGFGVPGFGVPGFGVPGFGVPGFGVPG
FGVPGFGVPGFGVPGFGVPGFGVPGFGVPGFGVPGFGVPGFGVPGFGVP -continued
GFGVPGFGVPGFGVPGFGVPGFGVPGFGVPGFGVPGFGVPGFGV

PGFGVPGFGVPGFGVPGFGVPGFGVPGFGVPGFGVPGFGVPGFG

VPGFGVPGFGVPGFGVPGFGVPGFGVPGFGVPGFGVPGFGVPGF

GVPGFGVPGFGVPGFGVPGFGVPGFGVPGFGVPGFGVPGFGVPG

FGVPGFGVPGFGVPGFGVPGFGVPGFGVPGFGVPGFGVPGFGVP

GFGVPGFGVPGFGVPGFGGRGIHHHHHH 1.1.2 Heterogeneous Protein-Polymers (Mixed Functionalities)

1.1.2.1 V20-EYFP-V40 (EYFP=Enhanced Yellow Fluorescent Protein) (54.1 kDa)

DNA-sequence
(SEQ ID NO: 9)
ATGACTGCAGGGAGCTCTTCTGGTGTTCCGGGTGTTGGTGTTCCGGGTG

TTGGTGTTCCGGGTGTTGGTGTTCCGGGTGTTGGTGTTCCGGGTGTTGG

TGTTCCGGGTGTTGGTGTTCCGGGTGTTGGTGTTCCGGGTGTTGGTGTT

CCGGGTGTTGGTGTTCCGGGTGTTGGTGTTCCGGGTGTTGGTGTTCCGG

GTGTTGGTGTTCCGGGTGTTGGTGTTCCGGGTGTTGGTGTTCCGGGTGT

TGGTGTTCCGGGTGTTGGTGTTCCGGGTGTTGGTGTTCCGGGTGTTGGT

GTTCCGGGTGTTGGTGTTCCGGGTGTTGGTATGGTGAGCAAGGGCGAGG

AGCTGTTCACCGGGGTGGTGCCCATCCTGGTCGAGCTGGACGGCGACGT

AAACGGCCACAAGTTCAGCGTGTCCGGCGAGGGCGAGGGCGATGCCACC

TACGGCAAGCTGACCCTGAAGTTCATCTGCACCACCGGCAAGCTGCCCG

TGCCCTGGCCCACCCTCGTGACCACCTTCGGCTACGGCCTGCAGTGCTT

CGCCCGCTACCCCGACCACATGAAGCAGCACGACTTCTTCAAGTCCGCC

ATGCCCGAAGGCTACGTCCAGGAGCGCACCATCTTCTTCAAGGACGACG

GCAACTACAAGACCCGCGCCGAGGTGAAGTTCGAGGGCGACACCCTGGT

GAACCGCATCGAGCTGAAGGGCATCGACTTCAAGGAGGACGGCAACATC

CTGGGGCACAAGCTGGAGTACAACTACAACAGCCACAACGTCTATATCA

TGGCCGACAAGCAGAAGAACGGCATCAAGGTGAACTTCAAGATCCGCCA

CAACATCGAGGACGGCAGCGTGCAGCTCGCCGACCACTACCAGCAGAAC

ACCCCCATCGGCGACGGCCCCGTGCTGCTGCCCGACAACCACTACCTGA

GCTACCAGTCCGCCCTGAGCAAAGACCCCAACGAGAAGCGCGATCACAT

GGTCCTGCTGGAGTTCGTGACCGCCGCCGGGATCACTCTCGGCATGGAC

GAGCTGTACAAGGGTGTTCCGGGTGTTGGTGTTCCGGGTGTTGGTGTTC

CGGGTGTTGGTGTTCCGGGTGTTGGTGTTCCGGGTGTTGGTGTTCCGGG

TGTTGGTGTTCCGGGTGTTGGTGTTCCGGGTGTTGGTGTTCCGGGTGTT

GGTGTTCCGGGTGTTGGTGTTCCGGGTGTTGGTGTTCCGGGTGTTGGTG

TTCCGGGTGTTGGTGTTCCGGGTGTTGGTGTTCCGGGTGTTGGTGTTCC

GGGTGTTGGTGTTCCGGGTGTTGGTGTTCCGGGTGTTGGTGTTCCGGGT

GTTGGTGTTCCGGGTGTTGGTGTTCCGGGTGTTGGTGTTCCGGGTGTTG

GTGTTCCGGGTGTTGGTGTTCCGGGTGTTGGTGTTCCGGGTGTTGGTGT

TCCGGGTGTTGGTGTTCCGGGTGTTGGTGTTCCGGGTGTTGGTGTTCCG

-continued
GGTGTTGGTGTTCCGGGTGTTGGTGTTCCGGGTGTTGGTGTTCCGGGTG

TTGGTGTTCCGGGTGTTGGTGTTCCGGGTGTTGGTGTTCCGGGTGTTGG

TGTTCCGGGTGTTGGTGTTCCGGGTGTTGGTGTTCCGGGTGTTGGTGTT

CCGGGTGTTGGTGTTCCGGGTGTTGGTGGAAGAGAAGCTTGGATCCTCG

AGCACCACCACCACCACCAC protein sequence
(SEQ ID NO: 10)
MTAGSSSGVPGVGVPGVGVPGVGVPGVGVPGVGVPGVGVPGVGVPGVGV

PGVGVPGVGVPGVGVPGVGVPGVGVPGVGVPGVGVPGVGVPGVGVPGVG

VPGVGVPGVGMVSKGEELFTGVVPILVELDGDVNGHKFSVSGEGEGDAT

YGKLTLKFICTTGKLPVPWPTLVTTFGYGLQCFARYPDHMKQHDFFKSA

MPEGYVQERTIFFKDDGNYKTRAEVKFEGDTLVNRIELKGIDFKEDGNI

LGHKLEYNYNSHNVYIMADKQKNGIKVNFKIRHNIEDGSVQLADHYQQN

TPIGDGPVLLPDNHYLSYQSALSKDPNEKRDHMVLLEFVTAAGITLGMD

ELYKGVPGVGVPGVGVPGVGVPGVGVPGVGVPGVGVPGVGVPGVGVPGV

GVPGVGVPGVGVPGVGVPGVGVPGVGVPGVGVPGVGVPGVGVPGVGVPG

VGVPGVGVPGVGVPGVGVPGVGVPGVGVPGVGVPGVGVPGVGVPGVGVP

GVGVPGVGVPGVGVPGVGVPGVGVPGVGVPGVGVPGVGVPGVGVPGVGV

PGVGVPGVGGREAWILEHHHHHH 1.1.2.2 ECFP-V40-EYFP 1.1.2.1 ECFP-V40-EYFP (ECFP=Enhanced Cyan Flourescent Protein) (72.6 kDa)

DNA-sequence
(SEQ ID NO: 11)
ATGGTGCACCCGAGCTCTTCTGGTATGGTGAGCAAGGGCGAGGAGCTGT

TCACCGGGGTGGTGCCCATCCTGGTCGAGCTGGACGGCGACGTAAACGG

CCACAAGTTCAGCGTGTCCGGCGAGGGCGAGGGCGATGCCACCTACGGC

AAGCTGACCCTGAAGTTCATCTGCACCACCGGCAAGCTGCCCGTGCCCT

GGCCCACCCTCGTGACCACCCTGACCTGGGGCGTGCAGTGCTTCAGCCG

CTACCCCGACCACATGAAGCAGCACGACTTCTTCAAGTCCGCCATGCCC

GAAGGCTACGTCCAGGAGCGCACCATCTTCTTCAAGGACGACGGCAACT

ACAAGACCCGCGCCGAGGTGAAGTTCGAGGGCGACACCCTGGTGAACCG

CATCGAGCTGAAGGGCATCGACTTCAAGGAGGACGGCAACATCCTGGGG

CACAAGCTGGAGTACAACTACATCAGCCACAACGTCTATATCACCGCCG

ACAAGCAGAAGAACGGCATCAAGGCCAACTTCAAGATCCGCCACAACAT

CGAGGACGGCAGCGTGCAGCTCGCCGACCACTACCAGCAGAACACCCCC

ATCGGCGACGGCCCCGTGCTGCTGCCCGACAACCACTACCTGAGCACCC

AGTCCGCCCTGAGCAAAGACCCCAACGAGAAGCGCGATCACATGGTCCT

GCTGGAGTTCGTGACCGCCGCCGGGATCACTCTCGGCATGGACGAGCTG

TACAAGGGTGTTCCGGGTGTTGGTGTTCCGGGTGTTGGTGTTCCGGGTG

TTGGTGTTCCGGGTGTTGGTGTTCCGGGTGTTGGTGTTCCGGGTGTTGG

TGTTCCGGGTGTTGGTGTTCCGGGTGTTGGTGTTCCGGGTGTTGGTGTT

-continued

CCGGGTGTTGGTGTTCCGGGTGTTGGTGTTCCGGGTGTTGGTGTTCCGG
GTGTTGGTGTTCCGGGTGTTGGTGTTCCGGGTGTTGGTGTTCCGGGTGT
TGGTGTTCCGGGTGTTGGTGTTCCGGGTGTTGGTGTTCCGGGTGTTGGT
GTTCCGGGTGTTGGTGTTCCGGGTGTTGGTGTTCCGGGTGTTGGTGTTC
CGGGTGTTGGTGTTCCGGGTGTTGGTGTTCCGGGTGTTGGTGTTCCGGG
TGTTGGTGTTCCGGGTGTTGGTGTTCCGGGTGTTGGTGTTCCGGGTGTT
GGTGTTCCGGGTGTTGGTGTTCCGGGTGTTGGTGTTCCGGGTGTTGGTG
TTCCGGGTGTTGGTGTTCCGGGTGTTGGTGTTCCGGGTGTTGGTGTTCC
GGGTGTTGGTGTTCCGGGTGTTGGTGTTCCGGGTGTTGGTGTTCCGGGT
GTTGGTGTTCCGGGTGTTGGTATGGTGAGCAAGGGCGAGGAGCTGTTCA
CCGGGGTGGTGCCCATCCTGGTCGAGCTGGACGGCGACGTAAACGGCCA
CAAGTTCAGCGTGTCCGGCGAGGGCGAGGGCGATGCCACCTACGGCAAG
CTGACCCTGAAGTTCATCTGCACCACCGGCAAGCTGCCCGTGCCCTGGC
CCACCCTCGTGACCACCTTCGGCTACGGCCTGCAGTGCTTCGCCCGCTA
CCCCGACCACATGAAGCAGCACGACTTCTTCAAGTCCGCCATGCCCGAA
GGCTACGTCCAGGAGCGCACCATCTTCTTCAAGGACGACGGCAACTACA
AGACCCGCGCCGAGGTGAAGTTCGAGGGCGACACCCTGGTGAACCGCAT
CGAGCTGAAGGGCATCGACTTCAAGGAGGACGGCAACATCCTGGGGCAC
AAGCTGGAGTACAACTACAACAGCCACAACGTCTATATCATGGCCGACA
AGCAGAAGAACGGCATCAAGGTGAACTTCAAGATCCGCCACAACATCGA
GGACGGCAGCGTGCAGCTCGCCGACCACTACCAGCAGAACACCCCCATC
GGCGACGGCCCCGTGCTGCTGCCCGACAACCACTACCTGAGCTACCAGT
CCGCCCTGAGCAAAGACCCCAACGAGAAGCGCGATCACATGGTCCTGCT
GGAGTTCGTGACCGCCGCCGGGATCACTCTCGGCATGGACGAGCTGTAC
AAGGGTGGAAGAGGAATTCTCGAGCACCACCACCACCACCAC protein sequence
(SEQ ID NO: 12)
MVHPSSSGMVSKGEELFTGVVPILVELDGDVNGHKFSVSGEGEGDATYG
KLTLKFICTTGKLPVPWPTLVTTLTWGVQCFSRYPDHMKQHDFFKSAMP
EGYVQERTIFFKDDGNYKTRAEVKFEGDTLVNRIELKGIDFKEDGNILG
HKLEYNYISHNVYITADKQKNGIKANFKIRHNIEDGSVQLADHYQQNTP
IGDGPVLLPDNHYLSTQSALSKDPNEKRDHMVLLEFVTAAGITLGMDEL
YKGVPGVGVPGVGVPGVGVPGVGVPGVGVPGVGVPGVGVPGVGVPGVGV
PGVGVPGVGVPGVGVPGVGVPGVGVPGVGVPGVGVPGVGVPGVGVPGVG
VPGVGVPGVGVPGVGVPGVGVPGVGVPGVGVPGVGVPGVGVPGVGVPGV
GVPGVGVPGVGVPGVGVPGVGVPGVGVPGVGVPGVGVPGVGVPGVGVPG
VGVPGVGMVSKGEELFTGVVPILVELDGDVNGHKFSVSGEGEGDATYGK
LTLKFICTTGKLPVPWPTLVTTFGYGLQCFARYPDHMKQHDFFKSAMPE
GYVQERTIFFKDDGNYKTRAEVKFEGDTLVNRIELKGIDFKEDGNILGH
KLEYNYNSHNVYIMADKQKNGIKVNEKIRHNIEDGSVQLADHYQQNTPI
GDGPVLLPDNHYLSYQSALSKDPNEKRDHMVLLEFVTAAGITLGMDELY
KGGRGILEHHHHHH 1.1.2.3 ELP-His-V20C1 (11.7 kDa)

DNA-sequence
(SEQ ID NO: 13)
ATGGGCAGCAGCCATCATCATCATCATCACAGCAGCGGCCTGGTGCCGC
GCGGCAGCCATATGGCCATGGGTGTTCCGGGTGTTGGTGTTCCGGGTGT
TGGTGTTCCGGGTGTTGGTGTTCCGGGTGTTGGTGTTCCGGGTGTTGGT
GTTCCGGGTGTTGGTGTTCCGGGTGTTGGTGTTCCGGGTGTTGGTGTTC
CGGGTGTTGGTGTTCCGGGTGTTGGTGTTCCGGGTGTTGGTGTTCCGGG
TGTTGGTGTTCCGGGTGTTGGTGTTCCGGGTGTTGGTGTTCCGGGTGTT
GGTGTTCCGGGTGTTGGTGTTCCGGGTGTTGGTGTTCCGGGTGTTGGTG
TTCCGGGTGTTGGTGTTCCGGGTGTTGGTGTTCCGGGTTGCGGTGGAAG
AGAATTC protein sequence
(SEQ ID NO: 14)
MGSSHHHHHHSSGLVPRGSHMAMGVPGVGVPGVGVPGVGVPGVGVPGVG
VPGVGVPGVGVPGVGVPGVGVPGVGVPGVGVPGVGVPGVGVPGVGVPGV
GVPGVGVPGVGVPGVGVPGVGVPGCGGREF 1.1.2.4 ELP-His-R20C1 (12.8 kDa)

DNA-sequence
(SEQ ID NO: 15)
ATGGGCAGCAGCCATCATCATCATCATCACAGCAGCGGCCTGGTGCCGC
GCGGCAGCCATATGGCCATGGGTGTTCCGGGTAGAGGTGTTCCGGGTAG
AGGTGTTCCGGGTAGAGGTGTTCCGGGTAGAGGTGTTCCGGGTAGAGGT
GTTCCGGGTAGAGGTGTTCCGGGTAGAGGTGTTCCGGGTAGAGGTGTTC
CGGGTAGAGGTGTTCCGGGTAGAGGTGTTCCGGGTAGAGGTGTTCCGGG
TAGAGGTGTTCCGGGTAGAGGTGTTCCGGGTAGAGGTGTTCCGGGTAGA
GGTGTTCCGGGTAGAGGTGTTCCGGGTAGAGGTGTTCCGGGTAGAGGTG
TTCCGGGTAGAGGTGTTCCGGGTAGAGGTGTTCCGGGTTGCGGTGGAAG
AGAATTC protein sequence
(SEQ ID NO: 16)
MGSSHHHHHHSSGLVPRGSHMAMGVPGRGVPGRGVPGRGVPGRGVPGRG
VPGRGVPGRGVPGRGVPGRGVPGRGVPGRGVPGRGVPGRGVPGRGVPGR
GVPGRGVPGRGVPGRGVPGRGVPGRGVPGCGGREF

1.1.2.5 R20C1F20-His (20.8 kDa)

DNA-sequence
(SEQ ID NO: 17)
ATGGGTGTTCCGGGTAGAGGTGTTCCGGGTAGAGGTGTTCCGGGTAGAGGTGTTCCGGGTAGAGGTGTTCCGGGTAG
AGGTGTTCCGGGTAGAGGTGTTCCGGGTAGAGGTGTTCCGGGTAGAGGTGTTCCGGGTAGAGGTGTTCCGGGTAGAG
GTGTTCCGGGTAGAGGTGTTCCGGGTAGAGGTGTTCCGGGTAGAGGTGTTCCGGGTAGAGGTGTTCCGGGTAGAGGT
GTTCCGGGTAGAGGTGTTCCGGGTAGAGGTGTTCCGGGTAGAGGTGTTCCGGGTAGAGGTGTTCCGGGTAGAGGTGT
TCCGGGTTGCGGTGTTCCGGGTTTCGGTGTTCCGGGTTTCGGTGTTCCGGGTTTCGGTGTTCCGGGTTTCGGTGTTC
*CGGGTTTCGGTGTTCCGGGTTTCGGTGTTCCGGGTTTCGGTGTTCCGGGTTTCGGTGTTCCGGGTTTCGGTGTTCCG*
*GGTTTCGGTGTTCCGGGTTTCGGTGTTCCGGGTTTCGGTGTTCCGGGTTTCGGTGTTCCGGGTTTCGGTGTTCCGGG*
*TTTCGGTGTTCCGGGTTTCGGTGTTCCGGGTTTCGGTGTTCCGGGTTTCGGTGTTCCGGGTTTCGGTGTTCCGGGTT*
*TCGGGT*GGAAGAGAATTGGCCGCACTCGAGCACCACCACCACCACCAC protein sequence
(SEQ ID NO: 18)
M**GVPGRGVPGRGVPGRGVPGRGVPGRGVPGRGVPGRGVPGRGVPGRGVPGRGVPGRGVPGRGVPGRGVPGRGVPGRG
VPGRGVPGRGVPGRGVPGRGVPGRGVPGCGVP*GFGVPGFGVPGFGVPGFGVPGFGVPGFGVPGFGVPGFGVPGFGVP*
*GFGVPGFGVPGFGVPGFGVPGFGVPGFGVPGFGVPGFGVPGFGVPGFGVPGFGVPGFGVPGFGVPGFG*GRELAALEHHHHHH

1.2 Resilin-Like ELP (Elastin-Like Protein): (V2Y1)15. (V2C1)20
1.2.1 ELP-(V2Y1)15 (22.7 kDa)

DNA-sequence
(SEQ ID NO: 19)
ATGGGCAGCAGCCATCATCATCATCATCACAGCAGCGGCCTGGTGCCGC
GCGGCAGCCATATGGCCATGGGCTCTTCTGGT**GTTCCGGGTGTTGGTGT
TCCGGGTGTTGGTGTTCCGGGTTACGTGTTCCGGGTGTTGGTGTTCCG
GGTGTTGGTGTTCCGGGTTACGTGTTCCGGGTGTTGGTGTTCCGGGTG
TTGGTGTTCCGGGTTACGGTGTTCCGGGTGTTGGTGTTCCGGGTGTTGG
TGTTCCGGGTTACGGTGTTCCGGGTGTTGGTGTTCCGGGTGTTGGTGTT
CCGGGTTACGGTGTTCCGGGTGTTGGTGTTCCGGGTGTTGGTGTTCCGG
GTTACGGTGTTCCGGGTGTTGGTGTTCCGGGTGTTGGTGTTCCGGGTTA
CGGTGTTCCGGGTGTTGGTGTTCCGGGTGTTGGTGTTCCGGGTTACGGT
GTTCCGGGTGTTGGTGTTCCGGGTGTTGGTGTTCCGGGTTACGGTGTTC
CGGGTGTTGGTGTTCCGGGTGTTGGTGTTCCGGGTTACGGTGTTCCGGG
TGTTGGTGTTCCGGGTGTTGGTGTTCCGGGTTACGGTGTTCCGGGTGTT
GGTGTTCCGGGTGTTGGTGTTCCGGGTTACGGTGTTCCGGGTGTTGGTG
TTCCGGGTGTTGGTGTTCCGGGTTACGGTGTTCCGGGTGTTGGTGTTCC
GGGTGTTGGTGTTCCGGGTTACGGTGTTCCGGGTGTTGGTGTTCCGGGT
GTTGGTGTTCCGGGTTACGGTGGAAGAGAATTC protein sequence
(SEQ ID NO: 20)
MGSSHHHHHHSSGLVPRGSHMAMGSSG**VPGVPGVGVPGYGVPGVGVP
GVGVPGYGVPGVGVPGVGVPGYGVPGVGVPGVGVPGYGVPGVGVPGVGV
PGYGVPGVGVPGVGVPGYGVPGVGVPGVGVPGYGVPGVGVPGVGVPGYG
VPGVGVPGVGVPGYGVPGVGVPGVGVPGYGVPGVGVPGVGVPGYGVPGV -continued
GVPGVGVPGYGVPGVGVPGVGVPGYGVPGVGVPGVGVPGYGVPGVGVPG
VGVPGYG**GREF

1.2.2 ELP-(V2C1)20-His (26.7 kDa)

DNA-sequence
(SEQ ID NO: 21)
ATGGTGCACCCGAGCTCTTCTGGT**GTTCCGGGTGTTGGTGTTCCGGGTG
TTGGTGTTCCGGGTTGCGGTGTTCCGGGTGTTGGTGTTCCGGGTGTTGG
TGTTCCGGGTTGCGGTGTTCCGGGTGTTGGTGTTCCGGGTGTTGGTGTT
CCGGGTTGCGGTGTTCCGGGTGTTGGTGTTCCGGGTGTTGGTGTTCCGG
GTTGCGGTGTTCCGGGTGTTGGTGTTCCGGGTGTTGGTGTTCCGGGT**TG
CGGTGTTCCGGGTGTTGGTGTTCCGGGTGTTGGTGTTCCGGGTTGC**GGT
GTTCCGGGTGTTGGTGTTCCGGGTGTTGGTGTTCCGGGTTGCGGTGTTC
CGGGTGTTGGTGTTCCGGGTGTTGGTGTTCCGGGTTGCGGTGTTCCGGG
TGTTGGTGTTCCGGGTGTTGGTGTTCCGGGTTGCGGTGTTCCGGGTGTT
GGTGTTCCGGGTGTTGGTGTTCCGGGTTGCGGTGTTCCGGGTGTTGGTG
TTCCGGGTGTTGGTGTTCCGGGTTGCGGTGTTCCGGGTGTTGGTGTTCC
GGGTGTTGGTGTTCCGGGTTGCGGTGTTCCGGGTGTTGGTGTTCCGGGT
GTTGGTGTTCCGGGTTGCGGTGTTCCGGGTGTTGGTGTTCCGGGTGTTG
GTGTTCCGGGTTGCGGTGTTCCGGGTGTTGGTGTTCCGGGTGTTGGTGT
TCCGGGTTGCGGTGTTCCGGGTGTTGGTGTTCCGGGTGTTGGTGTTCCG
GGTTGCGGTGTTCCGGGTGTTGGTGTTCCGGGTGTTGGTGTTCCGGGT**T
GCGGTGTTCCGGGTGTTGGTGTTCCGGGTGTTGGTGTTCCGGGTTGC**GG
TGTTCCGGGTGTTGGTGTTCCGGGTGTTGGTGTTCCGGGTTGCGGTGTT
CCGGGTGTTGGTGTTCCGGGTGTTGGTGTTCCGGGTTGCGGTGGAAGAG
AATTCACCACCACCACCACCAC -continued protein sequence (SEQ ID NO: 22)

MVHPSSSGVPGVGVPGVGVPGCGVPGVGVPGVGVPGCGVPGVGVPGVGV

PGCGVPGVGVPGVGVPGCGVPGVGVPGVGVPGCGVPGVGVPGVGVPGCG

VPGVGVPGVGVPGCGVPGVGVPGVGVPGCGVPGVGVPGVGVPGCGVPGV

GVPGVGVPGCGVPGVGVPGVGVPGCGVPGVGVPGVGVPGCGVPGVGVPG

VGVPGCGVPGVGVPGVGVPGCGVPGVGVPGVGVPGCGVPGVGVPGVGVP

GCGVPGVGVPGVGVPGCGVPGVGVPGVGVPGCGVPGVGVPGVGVPGCGV

PGVGVPGVGVPGCGGRGIHHHHHH

1.3 Amphiphilic Protein Block Copolymers
1.3.1 ELP-(V20R20) (18.2 kDa)

DNA-sequence (SEQ ID NO: 23)

ATGGGT<u>GTTCCGGGTGTTGGTGTTCCGGGTGTTGGTGTTCCGGGTGTTGGTGTTCCGGGTGTTGGTGTTCCGGGTGT</u>
<u>TGGTGTTCCGGGTGTTGGTGTTCCGGGTGTTGGTGTTCCGGGTGTTGGTGTTCCGGGTGTTGGTGTTCCGGGTGTTG</u>
<u>GTGTTCCGGGTGTTGGTGTTCCGGGTGTTGGTGTTCCGGGTGTTGGTGTTCCGGGTGTTGGTGTTCCGGGTGTTGGT</u>
<u>GTTCCGGGTGTTGGTGTTCCGGGTGTTGGTGTTCCGGGTGTTGGTGTTCCGGGTGTTGGTGTTCCGGGTGTTGGT</u>*GT*
*TCCGGGTAGAGGTGTTCCGGGTAGAGGTGTTCCGGGTAGAGGTGTTCCGGGTAGAGGTGTTCCGGGTAGAGGTGTTC*
*CGGGTAGAGGTGTTCCGGGTAGAGGTGTTCCGGGTAGAGGTGTTCCGGGTAGAGGTGTTCCGGGTAGAGGTGTTCCG*
*GGTAGAGGTGTTCCGGGTAGAGGTGTTCCGGGTAGAGGTGTTCCGGGTAGAGGTGTTCCGGGTAGAGGTGTTCCGGG*
*TAGAGGTGTTCCGGGTAGAGGTGTTCCGGGTAGAGGTGTTCCGGGTAGAGGT*GGAAGAGAAT
TC protein sequence (SEQ ID NO: 24)

MG<u>VPGVGVPGVGVPGVGVPGVGVPGVGVPGVGVPGVGVPGVGVPGVGVPGVGVPGVGVPGVGVPGVGVPGVGVPGVG</u>
<u>VPGVGVPGVGVPGVGVPGVGVPGVG</u>*VPGRGVPGRGVPGRGVPGRGVPGRGVPGRGVPGRGVPGRGVPGRGVPGRGVP*
*GRGVPGRGVPGRGVPGRGVPGRGVPGRGVPGRGVPGRGVPGRGVPGRG*GREF

1.3.2 ELP-(R40F20) (28.5 kDa)

DNA-sequence (SEQ ID NO: 25)

ATGGGT<u>GTTCCGGGTAGAGGTGTTCCGGGTAGAGGTGTTCCGGGTAGAGGTGTTCCGGGTAGAGGTGTTCCGGGTAG</u>
<u>AGGTGTTCCGGGTAGAGGTGTTCCGGGTAGAGGTGTTCCGGGTAGAGGTGTTCCGGGTAGAGGTGTTCCGGGTAGAG</u>
<u>GTGTTCCGGGTAGAGGTGTTCCGGGTAGAGGTGTTCCGGGTAGAGGTGTTCCGGGTAGAGGTGTTCCGGGTAGAGGT</u>
<u>GTTCCGGGTAGAGGTGTTCCGGGTAGAGGTGTTCCGGGTAGAGGTGTTCCGGGTAGAGGTGTTCCGGGTAGAGGTGT</u>
<u>TCCGGGTAGAGGTGTTCCGGGTAGAGGTGTTCCGGGTAGAGGTGTTCCGGGTAGAGGTGTTCCGGGTAGAGGTGTTC</u>
<u>CGGGTAGAGGTGTTCCGGGTAGAGGTGTTCCGGGTAGAGGTGTTCCGGGTAGAGGTGTTCCGGGTAGAGGTGTTCCG</u>
<u>GGTAGAGGTGTTCCGGGTAGAGGTGTTCCGGGTAGAGGT</u>*GTTCCGGGTAGAGGTGTTCCGGGTAGAGGTGTTCCGGG*
*TAGAGGTGTTCCGGGTAGAGGTGTTCCGGGTAGAGGTGTTCCGGGTAGAGGTGTTCCGGGTAGAGGTGTTCCGGGTT*
*TCGGTGTTCCGGGTTTCGGTGTTCCGGGTTTCGGTGTTCCGGGTTTCGGTGTTCCGGGTTTCGGTGTTCCGGGTTTC*
*GGTGTTCCGGGTTTCGGTGTTCCGGGTTTCGGTGTTCCGGGTTTCGGTGTTCCGGGTTTCGGTGTTCCGGGTTTCGG*
*TGTTCCGGGTTTCGGTGTTCCGGGTTTCGGTGTTCCGGGTTTCGGTGTTCCGGGTTTCGGTGTTCCGGGTTTCGGTG*
*TTCCGGGTTTCGGTGTTCCGGGTTTCGGTGTTCCGGGTTTCGGTGTTCCGGGTTTCGGT*GGAAGAGAATTC protein sequence (SEQ ID NO: 26)

MG<u>VPGRGVPGRGVPGRGVPGRGVPGRGVPGRGVPGRGVPGRGVPGRGVPGRGVPGRGVPGRGVPGRGVPGRGVPGRG</u>
<u>VPGRGVPGRGVPGRGVPGRGVPGRGVPGRGVPGRGVPGRGVPGRGVPGRGVPGRGVPGRGVPGRGVPGRGVPGRGVP</u>
<u>GRGVPGRGVPGRGVPGRGVPGRGVPGRGVPGRGVPGRGVPGRGVPGRG</u>*VPGFGVPGFGVPGFGVPGFGVPGFGVPGF*
*GVPGFGVPGFGVPGFGVPGFGVPGFGVPGFGVPGFGVPGFGVPGFGVPGFGVPGFGVPGFGVPGFGVPGFG*GREF

1.3.3 ELP-1E20F201 (18.6 kDa)

DNA-sequence (SEQ ID NO: 27)

ATGGGT<u>GTTCCGGGTGAAGGTGTTCCGGGTGAAGGTGTTCCGGGTGAAGGTGTTCCGGGTGAAGGTGTTCCGGGTGAAGGTGTTCCGGGTGAAGGTGTTCCGGGTGAAGGTGTTCCGGGTGAAGGTGTTCCGGGTGAAGGTGTTCCGGGTGAAGGTGTTCCGGGTGAAGGTGTTCCGGGTGAAGGTGTTCCGGGTGAAGGTGTTCCGGGTGAAGGTGTTCCGGGTGAAGGT</u>*GTTCCGGGTTTCGGTGTTCCGGGTTTCGGTGTTCCGGGTTTCGGTGTTCCGGGTTTCGGTGTTCCGGGTTTCGGTGTTCCGGGTTTCGGTGTTCCGGGTTTCGGTGTTCCGGGTTTCGGTGTTCCGGGTTTCGGTGTTCCGGGTTTCGGTGTTCCGGGTTTCGGTGTTCCGGGTTTCGGTGTTCCGGGTTTCGGTGTTCCGGGTTTCGGTGTTCCGGGTTTCGGTGTTCCGGGTTTCGGTGTTCCGGGTTTCGGTGTTCCGGGTTTCGGTGTTCCGGGTTTCGGTCTTCCGGGTTTCGGTGTTCCGGGTTTCGGTGTTCCGGGTTTCGGTGTTCCGGGTTTCGGTGTTCCGGGTTTCGGT*GGAAGAGAATTC protein sequence (SEQ ID NO: 28)

MGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGEFGVPGFGVPGFGGREF

1.3.4 EYFP-E20F20-His (47.7 kDa)

DNA-sequence (SEQ ID NO: 29)

<u>ATGGTGCACCCGAGCTCTTCTGGTATGGTGAGCAAGGGCGAGGAGCTGTTCACCGGGGTGGTGCCCATCCTGGTCGAGCTGGACGGCGACGTAAACGGCCACAAGTTCAGCGTGTCCGGCGAGGGCGAGGGCGATGCCACCTACGGCAAGCTGACCCTGAAGTTCATCTGCACCACCGGCAAGCTGCCCGTGCCCTGGCCCACCCTCGTGACCACCTTCGGCTACGGCCTGCAGTGCTTCGCCCGCTACCCCGACCACATGAAGCAGCACGACTTCTTCAAGTCCGCCATGCCCGAAGGCTACGTCCAGGAGCGCACCATCTTCTTCAAGGACGACGGCAACTACAAGACCCGCGCCGAGGTGAAGTTCGAGGGCGACACCCTGGTGAACCGCATCGAGCTGAAGGGCATCGACTTCAAGGAGGACGGCAACATCCTGGGGCACAAGCTGGAGTACAACTACAACAGCCACAACGTCTATATCATGGCCGACAAGCAGAAGAACGGCATCAAGGTGAACTTCAAGATCCGCCACAACATCGAGGACGGCAGCGTGCAGCTCGCCGACCACTACCAGCAGAACACCCCCATCGGCGACGGCCCCGTGCTGCTGCCCGACAACCACTACCTGAGCTACCAGTCCGCCCTGAGCAAAGACCCCAACGAGAAGCGCGATCACATGGTCCTGCTGGAGTTCGTGACCGCCGCCGGGATCACTCTCGGCATGGACGAGCTGTACAAGGCGGCCGCAACCGGT</u>GTTCCGGGTGAAGGTGTTCCGGGTGAAGGTGTTCCGGGTGAAGGTGTTCCGGGTGAAGGTGTTCCGGGTGAAGGTGTTCCGGGTGAAGGTGTTCCGGGTGAAGGTGTTCCGGGTGAAGGTGTTCCGGGTGAAGGTGTTCCGGGTGAAGGTGTTCCGGGTGAAGGTGTTCCGGGTGAAGGTGTTCCGGGTGAAGGTGTTCCGGGTGAAGGTGTTCCGGGTGAAGGTGTTCCGGGTGAAGGTGTTCCGGGTGAAGGTGTTCCGGGTGAAGGTGTTCCGGGTGAAGGTGTTCCGGGTTTCGGTGTTCCGGGTTTCGGTGTTCCGGGTTTCGGTGTTCCGGGTTTCGGTGTTCCGGGTTTCGGTGTTCCGGGTTTCGGTGTTCCGGGTTTCGGTGTTCCGGGTTTCGGTGTTCCGGGTTTCGGTGTTCCGGGTTTCGGTGTTCCGGGTTTCGGTGTTCCGGGTTTCGGTGTTCCGGGTTTCGGTGTTCCGGGTTTCGGTGTTCCGGGTTTCGGTGTTCCGGGTTTCGGTGTTCCGGGTTTCGGTGTTCCGGGTTTCGGTGTTCCGGGTTTCGGTGTTCCGGGTTTCGGTGGAAGAGAATTGATCCTCGAGCACCACCACCACCACCAC protein sequence (SEQ ID NO: 30)

<u>MVHPSSSGMVSKGEELFTGVVPILVELDGDVNGHKFSVSGEGEGDATYGKLTLKFICTTGKLPVPWPTLVTTFGYGLQCFARYPDHMKQHDFFKSAMPEGYVQERTIFFKDDGNYKTRAEVKFEGDTLVNRIELKGIDFKEDGNILGHKLEYNY</u>

-continued

<u>NSHNVYIMADKQKNGIKVNFKIRHNIEDGSVQLADHYQQNTPIGDGPVLLPDNHYLSYQSALSKDPNEKRDHMVLLE</u>

<u>FVTAAGITLGMDELYKAAATG</u>VPGEGVPGEGVPGEGVPGEGVPGEGVPGEGVPGEGVPGEGVPGEGVPGEGVPGEGV

PGEGVPGEGVPGEGVPGEGVPGEGVPGEGVPGEGVPGEGVPGEG_VPGFGVPGFGVPGFGVPGFGVPGFGVPGFGVPG_

_FGVPGHGVPGFGVPGFGVPGFGVPGFGVPGFGVPGFGVPGFGVPGFGVPGFGVPGFGVPGFGVPGFGVPGFG_GRELILEHHH

HHH

1.3.5 F70E40-mEGFP-His_(80.2 kDa)

DNA-sequence
(SEQ ID NO: 31)
ATGACTGCAGGGAGCTCTTCTGGTGTTCCGGGTTTCGGTGTTCCGGGTTTCGGTGTTCCGGGTTTCGGTGTT

CCGGGTTTCGGTGTTCCGGGTTTCGGTGTTCCGGGTTTCGGTGTTCCGGGTTTCGGTGTTCCGGGTTTCGGT

GTTCCGGGTTTCGGTGTTCCGGGTTTCGGTGTTCCGGGTTTCGGTGTTCCGGGTTTCGGTGTTCCGGGTTTC

GGTGTTCCGGGTTTCGGTGTTCCGGGTTTCGGTGTTCCGGGTTTCGGTGTTCCGGGTTTCGGTGTTCCGGGT

TTCGGTGTTCCGGGTTTCGGTGTTCCGGGTTTCGGTGTTCCGGGTTTCGGTGTTCCGGGTTTCGGTGTTCCG

GGTTTCGGTGTTCCGGGTTTCGGTGTTCCGGGTTTCGGTGTTCCGGGTTTCGGTGTTCCGGGTTTCGGTGTT

CCGGGTTTCGGTGTTCCGGGTTTCGGTGTTCCGGGTTTCGGTGTTCCGGGTTTCGGTGTTCCGGGTTTCGGT

GTTCCGGGTTTCGGTGTTCCGGGTTTCGGTGTTCCGGGTTTCGGTGTTCCGGGTTTCGGTGTTCCGGGTTTC

GGTGTTCCGGGTTTCGGTGTTCCGGGTTTCGGTGTTCCGGGTTTCGGTGTTCCGGGTTTCGGTGTTCCGGGT

TTCGGTGTTCCGGGTTTCGGTGTTCCGGGTTTCGGTGTTCCGGGTTTCGGTGTTCCGGGTTTCGGTGTTCCG

GGTTTCGGTGTTCCGGGTTTCGGTGTTCCGGGTTTCGGTGTTCCGGGTTTCGGTGTTCCGGGTTTCGGTGTT

CCGGGTTTCGGTGTTCCGGGTTTCGGTGTTCCGGGTTTCGGTGTTCCGGGTTTCGGTGTTCCGGGTTTCGGT

GTTCCGGGTTTCGGTGTTCCGGGTTTCGGTGTTCCGGGTTTCGGTGTTCCGGGTTTCGGTGTTCCGGGTTTC

GGTGTTCCGGGTTTCGGTGTTCCGGGTTTCGGTGTTCCGGGTTTCGGTGTTCCGGGTTTCGGTGTTCCGGGT

TTCGGTGTTCCGGGTTTCGGTGTTCCGGGTTTCGGTGTTCCGGGTTTCGGTGTTCCGGGTTTCGGT_GTTCCG_

_GGTGAAGGTGTTCCGGGTGAAGGTGTTCCGGGTGAAGGTGTTCCGGGTGAAGGTGTTCCGGGTGAAGGTGTT_

_CCGGGTGAAGGTGTTCCGGGTGAAGGTGTTCCGGGTGAAGGTGTTCCGGGTGAAGGTGTTCCGGGTGAAGGT_

_GTTCCGGGTGAAGGTGTTCCGGGTGAAGGTGTTCCGGGTGAAGGTGTTCCGGGTGAAGGTGTTCCGGGTGAA_

_GGTGTTCCGGGTGAAGGTGTTCCGGGTGAAGGTGTTCCGGGTGAAGGTGTTCCGGGTGAAGGTGTTCCGGGT_

_GAAGGTGTTCCGGGTGAAGGTGTTCCGGGTGAAGGTGTTCCGGGTGAAGGTGTTCCGGGTGAAGGTGTTCCG_

_GGTGAAGGTGTTCCGGGTGAAGGTGTTCCGGGTGAAGGTGTTCCGGGTGAAGGTGTTCCGGGTGAAGGTGTT_

_CCGGGTGAAGGTGTTCCGGGTGAAGGTGTTCCGGGTGAAGGTGTTCCGGGTGAAGGTGTTCCGGGTGAAGGT_

_GTTCCGGGTGAAGGTGTTCCGGGTGAAGGTGTTCCGGGTGAAGGTGTTCCGGGTGAAGGTGTTCCGGGTGAA_

_GGTGTTCCGGGTGAAGGT_GGAAGAGAATTCCGGCCGATGGTGAGCAAGGGCGAGGAGCTGTTCACCGGGGTG

GTGCCCATCCTGGTCGAGCTGGACGGCGACGTAAACGGCCACAAGTTCAGCGTGTCCGGCGAGGGCGAGGGC

GATGCCACCTACGGCAAGCTGACCCTGAAGTTCATCTGCACCACCGGCAAGCTGCCCGTGCCCTGGCCCACC

CTCGTGACCACCCTGACCTACGGCGTGCAGTGCTTCAGCCGCTACCCCGACCACATGAAGCAGCACGACTTC

TTCAAGTCCGCCATGCCCGAAGGCTACGTCCAGGAGCGCACCATCTTCTTCAAGGACGACGGCAACTACAAG

```
ACCCGCGCCGAGGTGAAGTTCGAGGGCGACACCCTGGTGAACCGCATCGAGCTGAAGGGCATCGACTTCAAG

CACCACCACCACCACCAC
``` protein sequence
(SEQ ID NO: 32)

MTAGSSSGVPGFG**VPGFGVPGFGVPGFGVPGFGVPGFGVPGFGVPGFGVPGFGVPGFGVPGFGVPGFGVPGF
GVPGFGVPGFGVPGFGVPGFGVPGFGVPGFGVPGFGVPGFGVPGFGVPGFGVPGFGVPGFGVPGFGVPGFGV
PGFGVPGFGVPGFGVPGFGVPGFGVPGFGVPGFGVPGFGVPGFGVPGFGVPGFGVPGFGVPGFGVPGFGVPG
FGVPGFGVPGFGVPGFGVPGFGVPGFGVPGFGVPGFGVPGFGVPGFGVPGFGVPGFGVPGFGVPGFGVPGFG
VPGFGVPGFGVPGFGVPGFGVPGFGVPGFGVPGFGVPGFGVPGFGVPGFGVPGFGVPGFGVPGFGVPGFGVP**
*GEGVPGEGVPGEGVPGEGVPGEGVPGEGVPGEGVPGEGVPGEGVPGEGVPGEGVPGEGVPGEGVPGEGVPGE
GVPGEGVPGEGVPGEGVPGEGVPGEGVPGEGVPGEGVPGEGVPGEGVPGEGVPGEGVPGEGVPGEGVPGEGV
PGEGVPGEGVPGEGVPGEGVPGEGVPGEGVPGEGVPGEGVPGEGVPGEGVPGEG*GREFRPMVSKGEELFTGV
VPILVELDGDVNGHKFSVSGEGEGDATYGKLTLKFICTTGKLPVPWPTLVTTLTYGVQCFSRYPDHMKQHDF
FKSAMPEGYVQERTIFFKDDGNYKTRAEVKFEGDTLVNRIELKGIDFKEDGNILGHKLEYNYNSHNVYIMAD
KQKNGIKVNFKIRHNIEDGSVQLADHYQQNTPIGDGPVLLPDNHYLSTQSKLSKDPNEKRDHMVLLEFVTAA
GITLGMDELYKAAATGGREAWILEHHHHHH

1.4 Structural Protein-Polymers (not ELP Derived)

1.4.1 Recombinant Resilin Protein-Polymer: Res30-his (30 Repeat Units of 15 AS Monomer) (41.8 kDa)

DNA-sequence
(SEQ ID NO: 33)

```
ATGGGTGGTCGACCTTCTGATTCTTACGGTGCTCCTGGTGGTGGTAATG
GTGGTCGACCTTCTGATTCTTACGGTGCTCCTGGTGGTGGTAATGGTGG
TCGACCTTCTGATTCTTACGGTGCTCCTGGTGGTGGTAATGGTGGTCGA
CCTTCTGATTCTTACGGTGCTCCTGGTGGTGGTAATGGTGGTCGACCTT
CTGATTCTTACGGTGCTCCTGGTGGTGGTAATGGTGGTCGACCTTCTGA
TTCTTACGGTGCTCCTGGTGGTGGTAATGGTGGTCGACCTTCTGATTCT
TACGGTGCTCCTGGTGGTGGTAATGGTGGTCGACCTTCTGATTCTTACG
GTGCTCCTGGTGGTGGTAATGGTGGTCGACCTTCTGATTCTTACGGTGC
TCCTGGTGGTGGTAATGGTGGTCGACCTTCTGATTCTTACGGTGCTCCT
GGTGGTGGTAATGGTGGTCGACCTTCTGATTCTTACGGTGCTCCTGGTG
GTGGTAATGGTGGTCGACCTTCTGATTCTTACGGTGCTCCTGGTGGTGG
TAATGGTGGTCGACCTTCTGATTCTTACGGTGCTCCTGGTGGTGGTAAT
GGTGGTCGACCTTCTGATTCTTACGGTGCTCCTGGTGGTGGTAATGGTG
GTCGACCTTCTGATTCTTACGGTGCTCCTGGTGGTGGTAATGGTGGTCG
ACCTTCTGATTCTTACGGTGCTCCTGGTGGTGGTAATGGTGGTCGACCT
TCTGATTCTTACGGTGCTCCTGGTGGTGGTAATGGTGGTCGACCTTCTG
ATTCTTACGGTGCTCCTGGTGGTGGTAATGGTGGTCGACCTTCTGATTC
TTACGGTGCTCCTGGTGGTGGTAATGGTGGTCGACCTTCTGATTCTTAC
GGTGCTCCTGGTGGTGGTAATGGTGGTCGACCTTCTGATTCTTACGGTG
CTCCTGGTGGTGGTAATGGTGGTCGACCTTCTGATTCTTACGGTGCTCC
TGGTGGTGGTAATGGTGGTCGACCTTCTGATTCTTACGGTGCTCCTGGT
GGTGGTAATGGTGGTCGACCTTCTGATTCTTACGGTGCTCCTGGTGGTG
GTAATGGTGGTCGACCTTCTGATTCTTACGGTGCTCCTGGTGGTGGTAA
TGGTGGTCGACCTTCTGATTCTTACGGTGCTCCTGGTGGTGGTAATGGT
GGTCGACCTTCTGATTCTTACGGTGCTCCTGGTGGTGGTAATGGTGGTC
GACCTTCTGATTCTTACGGTGCTCCTGGTGGTGGTAATGGTGGTCGACC
TTCTGATTCTTACGGTGCTCCTGGTGGTGGTAATGGTGGTCGACCTTCT
GATTCTTACGGTGCTCCTGGTGGTGGTAATGGTGGAAGAGAATTGATCC
TCGAGCACCACCACCACCACCAC
``` protein sequence
(SEQ ID NO: 34)

MGGRPSDSYGAPGGGNGGRPSDSYGAPGGGNGGRPSDSYGAPGGGNGGR
PSDSYGAPGGGNGGRPSDSYGAPGGGNGGRPSDSYGAPGGGNGGRPSDS
YGAPGGGNGGRPSDSYGAPGGGNGGRPSDSYGAPGGGNGGRPSDSYGAP
GGGNGGRPSDSYGAPGGGNGGRPSDSYGAPGGGNGGRPSDSYGAPGGGN
GGRPSDSYGAPGGGNGGRPSDSYGAPGGGNGGRPSDSYGAPGGGNGGRP
SDSYGAPGGGNGGRPSDSYGAPGGGNGGRPSDSYGAPGGGNGGRPSDSY
GAPGGGNGGRPSDSYGAPGGGNGGRPSDSYGAPGGGNGGRPSDSYGAPG

GGNGGRPSDSYGAPGGGNGGRPSDSYGAPGGGNGGRPSDSYGAPGGGNG
GRPSDSYGAPGGGNGGRPSDSYGAPGGGNGGRPSDSYGAPGGGNGGRPS
DSYGAPGGGNGGRELILEHHHHHH 1.4.2 Recombinant Spidersilk-Protein-Polymer: Spisi80 (80 Repeat Units of 35 AS Monomer) (231.4 kDa)

DNA-sequence
(SEQ ID NO: 35)
ATGACTGCAGGGAGCTCTTCTGGTCGTGGTGGTCTGGGTGGTCAGGGTG
CTGGTATGGCTGCTGCTGCTGCTATGGGTGGTGCTGGTCAGGGTGGTTA
CGGTGGTCTGGGTTCTCAGGGTACCTCTGGTCGTGGTGGTCTGGGTGGT
CAGGGTGCTGGTATGGCTGCTGCTGCTGCTATGGGTGGTGCTGGTCAGG
GTGGTTACGGTGGTCTGGGTTCTCAGGGTACCTCTGGTCGTGGTGGTCT
GGGTGGTCAGGGTGCTGGTATGGCTGCTGCTGCTGCTATGGGTGGTGCT
GGTCAGGGTGGTTACGGTGGTCTGGGTTCTCAGGGTACCTCTGGTCGTG
GTGGTCTGGGTGGTCAGGGTGCTGGTATGGCTGCTGCTGCTGCTATGGG
TGGTGCTGGTCAGGGTGGTTACGGTGGTCTGGGTTCTCAGGGTACCTCT
GGTCGTGGTGGTCTGGGTGGTCAGGGTGCTGGTATGGCTGCTGCTGCTG
CTATGGGTGGTGCTGGTCAGGGTGGTTACGGTGGTCTGGGTTCTCAGGG
TACCTCTGGTCGTGGTGGTCTGGGTGGTCAGGGTGCTGGTATGGCTGCT
GCTGCTGCTATGGGTGGTGCTGGTCAGGGTGGTTACGGTGGTCTGGGTT
CTCAGGGTACCTCTGGTCGTGGTGGTCTGGGTGGTCAGGGTGCTGGTAT
GGCTGCTGCTGCTGCTATGGGTGGTGCTGGTCAGGGTGGTTACGGTGGT
CTGGGTTCTCAGGGTACCTCTGGTCGTGGTGGTCTGGGTGGTCAGGGTG
CTGGTATGGCTGCTGCTGCTGCTATGGGTGGTGCTGGTCAGGGTGGTTA
CGGTGGTCTGGGTTCTCAGGGTACCTCTGGTCGTGGTGGTCTGGGTGGT
CAGGGTGCTGGTATGGCTGCTGCTGCTGCTATGGGTGGTGCTGGTCAGG
GTGGTTACGGTGGTCTGGGTTCTCAGGGTACCTCTGGTCGTGGTGGTCT
GGGTGGTCAGGGTGCTGGTATGGCTGCTGCTGCTGCTATGGG
TGGTGCTGGTCAGGGTGGTTACGGTGGTCTGGGTTCTCAGGGTACCTCT
GGTCGTGGTGGTCTGGGTGGTCAGGGTGCTGGTATGGCTGCTGCTGCTG
CTATGGGTGGTGCTGGTCAGGGTGGTTACGGTGGTCTGGGTTCTCAGGG
TACCTCTGGTCGTGGTGGTCTGGGTGGTCAGGGTGCTGGTATGGCTGCT
GCTGCTGCTATGGGTGGTGCTGGTCAGGGTGGTTACGGTGGTCTGGGTT
CTCAGGGTACCTCTGGTCGTGGTGGTCTGGGTGGTCAGGGTGCTGGTAT
GGCTGCTGCTGCTGCTATGGGTGGTGCTGGTCAGGGTGGTTACGGTGGT
CTGGGTTCTCAGGGTACCTCTGGTCGTGGTGGTCTGGGTGGTCAGGGTG
CTGGTATGGCTGCTGCTGCTGCTATGGGTGGTGCTGGTCAGGGTGGTTA
CGGTGGTCTGGGTTCTCAGGGTACCTCTGGTCGTGGTGGTCTGGGTGGT
CAGGGTGCTGGTATGGCTGCTGCTGCTGCTATGGGTGGTGCTGGTCAGG
GTGGTTACGGTGGTCTGGGTTCTCAGGGTACCTCTGGTCGTGGTGGTCT
GGGTGGTCAGGGTGCTGGTATGGCTGCTGCTGCTGCTATGGGTGGTGCT
GGTCAGGGTGGTTACGGTGGTCTGGGTTCTCAGGGTACCTCTGGTCGTG
GTGGTCTGGGTGGTCAGGGTGCTGGTATGGCTGCTGCTGCTGCTATGGG
TGGTGCTGGTCAGGGTGGTTACGGTGGTCTGGGTTCTCAGGGTACCTCT
GGTCGTGGTGGTCTGGGTGGTCAGGGTGCTGGTATGGCTGCTGCTGCTG
CTATGGGTGGTGCTGGTCAGGGTGGTTACGGTGGTCTGGGTTCTCAGGG
TACCTCTGGTCGTGGTGGTCTGGGTGGTCAGGGTGCTGGTATGGCTGCT
GCTGCTGCTATGGGTGGTGCTGGTCAGGGTGGTTACGGTGGTCTGGGTT
CTCAGGGTACCTCTGGTCGTGGTGGTCTGGGTGGTCAGGGTGCTGGTAT
GGCTGCTGCTGCTGCTATGGGTGGTGCTGGTCAGGGTGGTTACGGTGGT
CTGGGTTCTCAGGGTACCTCTGGTCGTGGTGGTCTGGGTGGTCAGGGTG
CTGGTATGGCTGCTGCTGCTGCTATGGGTGGTGCTGGTCAGGGTGGTTA
CGGTGGTCTGGGTTCTCAGGGTACCTCTGGTCGTGGTGGTCTGGGTGGT
CAGGGTGCTGGTATGGCTGCTGCTGCTGCTATGGGTGGTGCTGGTCAGG
GTGGTTACGGTGGTCTGGGTTCTCAGGGTACCTCTGGTCGTGGTGGTCT
GGGTGGTCAGGGTGCTGGTATGGCTGCTGCTGCTGCTATGGGTGGTGCT
GGTCAGGGTGGTTACGGTGGTCTGGGTTCTCAGGGTACCTCTGGTCGTG
GTGGTCTGGGTGGTCAGGGTGCTGGTATGGCTGCTGCTGCTGCTATGGG
TGGTGCTGGTCAGGGTGGTTACGGTGGTCTGGGTTCTCAGGGTACCTCT
GGTCGTGGTGGTCTGGGTGGTCAGGGTGCTGGTATGGCTGCTGCTGCTG
CTATGGGTGGTGCTGGTCAGGGTGGTTACGGTGGTCTGGGTTCTCAGGG
TACCTCTGGTCGTGGTGGTCTGGGTGGTCAGGGTGCTGGTATGGCTGCT
GCTGCTGCTATGGGTGGTGCTGGTCAGGGTGGTTACGGTGGTCTGGGTT
CTCAGGGTACCTCTGGTCGTGGTGGTCTGGGTGGTCAGGGTGCTGGTAT -continued

```
GGCTGCTGCTGCTGCTATGGGTGGTGCTGGTCAGGGTGGTTACGGTGGT
CTGGGTTCTCAGGGTACCTCTGGTCGTGGTGGTCTGGGTGGTCAGGGTG
CTGGTATGGCTGCTGCTGCTGCTATGGGTGGTGCTGGTCAGGGTGGTTA
CGGTGGTCTGGGTTCTCAGGGTACCTCTGGTCGTGGTGGTCTGGGTGGT
CAGGGTGCTGGTATGGCTGCTGCTGCTGCTATGGGTGGTGCTGGTCAGG
GTGGTTACGGTGGTCTGGGTTCTCAGGGTACCTCTGGTCGTGGTGGTCT
GGGTGGTCAGGGTGCTGGTATGGCTGCTGCTGCTGCTATGGGTGGTGCT
GGTCAGGGTGGTTACGGTGGTCTGGGTTCTCAGGGTACCTCTGGTCGTG
GTGGTCTGGGTGGTCAGGGTGCTGGTATGGCTGCTGCTGCTGCTATGGG
TGGTGCTGGTCAGGGTGGTTACGGTGGTCTGGGTTCTCAGGGTACCTCT
GGTCGTGGTGGTCTGGGTGGTCAGGGTGCTGGTATGGCTGCTGCTGCTG
CTATGGGTGGTGCTGGTCAGGGTGGTTACGGTGGTCTGGGTTCTCAGGG
TACCTCTGGTCGTGGTGGTCTGGGTGGTCAGGGTGCTGGTATGGCTGCT
GCTGCTGCTATGGGTGGTGCTGGTCAGGGTGGTTACGGTGGTCTGGGTT
CTCAGGGTACCTCTGGTCGTGGTGGTCTGGGTGGTCAGGGTGCTGGTAT
GGCTGCTGCTGCTGCTATGGGTGGTGCTGGTCAGGGTGGTTACGGTGGT
CTGGGTTCTCAGGGTACCTCTGGTCGTGGTGGTCTGGGTGGTCAGGGTG
CTGGTATGGCTGCTGCTGCTGCTATGGGTGGTGCTGGTCAGGGTGGTTA
CGGTGGTCTGGGTTCTCAGGGTACCTCTGGTCGTGGTGGTCTGGGTGGT
CAGGGTGCTGGTATGGCTGCTGCTGCTGCTATGGGTGGTGCTGGTCAGG
GTGGTTACGGTGGTCTGGGTTCTCAGGGTACCTCTGGTCGTGGTGGTCT
GGGTGGTCAGGGTGCTGGTATGGCTGCTGCTGCTGCTATGGGTGGTGCT
GGTCAGGGTGGTTACGGTGGTCTGGGTTCTCAGGGTACCTCTGGTCGTG
GTGGTCTGGGTGGTCAGGGTGCTGGTATGGCTGCTGCTGCTGCTATGGG
TGGTGCTGGTCAGGGTGGTTACGGTGGTCTGGGTTCTCAGGGTACCTCT
GGTCGTGGTGGTCTGGGTGGTCAGGGTGCTGGTATGGCTGCTGCTGCTG
CTATGGGTGGTGCTGGTCAGGGTGGTTACGGTGGTCTGGGTTCTCAGGG
TACCTCTGGTCGTGGTGGTCTGGGTGGTCAGGGTGCTGGTATGGCTGCT
GCTGCTGCTATGGGTGGTGCTGGTCAGGGTGGTTACGGTGGTCTGGGTT
CTCAGGGTACCTCTGGTCGTGGTGGTCTGGGTGGTCAGGGTGCTGGTAT
GGCTGCTGCTGCTGCTATGGGTGGTGCTGGTCAGGGTGGTTACGGTGGT
CTGGGTTCTCAGGGTACCTCTGGTCGTGGTGGTCTGGGTGGTCAGGGTG
CTGGTATGGCTGCTGCTGCTGCTATGGGTGGTGCTGGTCAGGGTGGTTA
CGGTGGTCTGGGTTCTCAGGGTACCTCTGGTCGTGGTGGTCTGGGTGGT
CAGGGTGCTGGTATGGCTGCTGCTGCTGCTATGGGTGGTGCTGGTCAGG
GTGGTTACGGTGGTCTGGGTTCTCAGGGTACCTCTGGTCGTGGTGGTCT
GGGTGGTCAGGGTGCTGGTATGGCTGCTGCTGCTGCTATGGGTGGTGCT
GGTCAGGGTGGTTACGGTGGTCTGGGTTCTCAGGGTACCTCTGGTCGTG
```

-continued

```
CTATGGGTGGTGCTGGTCAGGGTGGTTACGGTGGTCTGGGTTCTCAGGG
TACCTCTGGTCGTGGTGGTCTGGGTGGTCAGGGTGCTGGTATGGCTGCT
GCTGCTGCTATGGGTGGTGCTGGTCAGGGTGGTTACGGTGGTCTGGGTT
CTCAGGGTACCTCTGGTCGTGGTGGTCTGGGTGGTCAGGGTGCTGGTAT
GGCTGCTGCTGCTGCTATGGGTGGTGCTGGTCAGGGTGGTTACGGTGGT
CTGGGTTCTCAGGGTACCTCTGGTCGTGGTGGTCTGGGTGGTCAGGGTG
CTGGTATGGCTGCTGCTGCTGCTATGGGTGGTGCTGGTCAGGGTGGTTA
CGGTGGTCTGGGTTCTCAGGGTACCTCTGGTCGTGGTGGTCTGGGTGGT
CAGGGTGCTGGTATGGCTGCTGCTGCTGCTATGGGTGGTGCTGGTCAGG
GTGGTTACGGTGGTCTGGGTTCTCAGGGTACCTCTGGTCGTGGTGGTCT
GGGTGGTCAGGGTGCTGGTATGGCTGCTGCTGCTGCTATGGGTGGTGCT
GGTCAGGGTGGTTACGGTGGTCTGGGTTCTCAGGGTACCTCTGGTCGTG
GTGGTCTGGGTGGTCAGGGTGCTGGTATGGCTGCTGCTGCTGCTATGGG
TGGTGCTGGTCAGGGTGGTTACGGTGGTCTGGGTTCTCAGGGTACCTCT
GGTCGTGGTGGTCTGGGTGGTCAGGGTGCTGGTATGGCTGCTGCTGCTG
CTATGGGTGGTGCTGGTCAGGGTGGTTACGGTGGTCTGGGTTCTCAGGG
TACCTCTGGTCGTGGTGGTCTGGGTGGTCAGGGTGCTGGTATGGCTGCT
GCTGCTGCTATGGGTGGTGCTGGTCAGGGTGGTTACGGTGGTCTGGGTT
CTCAGGGTACCTCTGGTCGTGGTGGTCTGGGTGGTCAGGGTGCTGGTAT
GGCTGCTGCTGCTGCTATGGGTGGTGCTGGTCAGGGTGGTTACGGTGGT
CTGGGTTCTCAGGGTACCTCTGGTCGTGGTGGTCTGGGTGGTCAGGGTG
CTGGTATGGCTGCTGCTGCTGCTATGGGTGGTGCTGGTCAGGGTGGTTA
CGGTGGTCTGGGTTCTCAGGGTACCTCTGGTCGTGGTGGTCTGGGTGGT
CAGGGTGCTGGTATGGCTGCTGCTGCTGCTATGGGTGGTGCTGGTCAGG
GTGGTTACGGTGGTCTGGGTTCTCAGGGTACCTCTGGTCGTGGTGGTCT
GGGTGGTCAGGGTGCTGGTATGGCTGCTGCTGCTGCTATGGGTGGTGCT
GGTCAGGGTGGTTACGGTGGTCTGGGTTCTCAGGGTACCTCTGGTCGTG
GTGGTCTGGGTGGTCAGGGTGCTGGTATGGCTGCTGCTGCTGCTATGGG
TGGTGCTGGTCAGGGTGGTTACGGTGGTCTGGGTTCTCAGGGTACCTCT
GGTCGTGGTGGTCTGGGTGGTCAGGGTGCTGGTATGGCTGCTGCTGCTG
CTATGGGTGGTGCTGGTCAGGGTGGTTACGGTGGTCTGGGTTCTCAGGG
TACCTCTGGTCGTGGTGGTCTGGGTGGTCAGGGTGCTGGTATGGCTGCT
GCTGCTGCTATGGGTGGTGCTGGTCAGGGTGGTTACGGTGGTCTGGGTT
CTCAGGGTACCTCTGGTCGTGGTGGTCTGGGTGGTCAGGGTGCTGGTAT
GGCTGCTGCTGCTGCTATGGGTGGTGCTGGTCAGGGTGGTTACGGTGGT
CTGGGTTCTCAGGGTACCTCTGGTCGTGGTGGTCTGGGTGGTCAGGGTG
CTGGTATGGCTGCTGCTGCTGCTATGGGTGGTGCTGGTCAGGGTGGTTA
CGGTGGTCTGGGTTCTCAGGGTACCTCTGGTCGTGGTGGTCTGGGTGGT
CAGGGTGCTGGTATGGCTGCTGCTGCTGCTATGGGTGGTGCTGGTCAGG
GTGGTTACGGTGGTCTGGGTTCTCAGGGTACCTCTGGTCGTGGTGGTCT
```

```
GGGTGGTCAGGGTGCTGGTATGGCTGCTGCTGCTGCTATGGGTGGTGCT
GGTCAGGGTGGTTACGGTGGTCTGGGTTCTCAGGGTACCTCTGGTCGTG
GTGGTCTGGGTGGTCAGGGTGCTGGTATGGCTGCTGCTGCTGCTATGGG
TGGTGCTGGTCAGGGTGGTTACGGTGGTCTGGGTTCTCAGGGTACCTCT
GGTCGTGGTGGTCTGGGTGGTCAGGGTGCTGGTATGGCTGCTGCTGCTG
CTATGGGTGGTGCTGGTCAGGGTGGTTACGGTGGTCTGGGTTCTCAGGG
TACCTCTGGTCGTGGTGGTCTGGGTGGTCAGGGTGCTGGTATGGCTGCT
GCTGCTGCTATGGGTGGTGCTGGTCAGGGTGGTTACGGTGGTCTGGGTT
CTCAGGGTACCTCTGGTCGTGGTGGTCTGGGTGGTCAGGGTGCTGGTAT
GGCTGCTGCTGCTGCTATGGGTGGTGCTGGTCAGGGTGGTTACGGTGGT
CTGGGTTCTCAGGGTACCTCTGGTCGTGGTGGTCTGGGTGGTCAGGGTG
CTGGTATGGCTGCTGCTGCTGCTATGGGTGGTGCTGGTCAGGGTGGTTA
CGGTGGTCTGGGTTCTCAGGGTACCTCTGGTCGTGGTGGTCTGGGTGGT
CAGGGTGCTGGTATGGCTGCTGCTGCTGCTATGGGTGGTGCTGGTCAGG
GTGGTTACGGTGGTCTGGGTTCTCAGGGTACCTCTGGTCGTGGTGGTCT
GGGTGGTCAGGGTGCTGGTATGGCTGCTGCTGCTGCTATGGGTGGTGCT
GGTCAGGGTGGTTACGGTGGTCTGGGTTCTCAGGGTACCTCTGGTGGAA
GAGAATTC
protein sequence
                                        (SEQ ID NO: 36)
MTAGSSSGRGGLGGQGAGMAAAAMGGAGQGGYGGLGSQGTSGRGGLGG
QGAGMAAAAMGGAGQGGYGGLGSQGTSGRGGLGGQGAGMAAAAMGGA
GQGGYGGLGSQGTSGRGGLGGQGAGMAAAAMGGAGQGGYGGLGSQGTS
GRGGLGGQGAGMAAAAMGGAGQGGYGGLGSQGTSGRGGLGGQGAGMAA
AAAMGGAGQGGYGGLGSQGTSGRGGLGGQGAGMAAAAMGGAGQGGYGG
LGSQGTSGRGGLGGQGAGMAAAAMGGAGQGGYGGLGSQGTSGRGGLGG
QGAGMAAAAMGGAGQGGYGGLGSQGTSGRGGLGGQGAGMAAAAMGGA
GQGGYGGLGSQGTSGRGGLGGQGAGMAAAAMGGAGQGGYGGLGSQGTS
GRGGLGGQGAGMAAAAMGGAGQGGYGGLGSQGTSGRGGLGGQGAGMAA
AAAMGGAGQGGYGGLGSQGTSGRGGLGGQGAGMAAAAMGGAGQGGYGG
LGSQGTSGRGGLGGQGAGMAAAAMGGAGQGGYGGLGSQGTSGRGGLGG
QGAGMAAAAMGGAGQGGYGGLGSQGTSGRGGLGGQGAGMAAAAMGGA
GQGGYGGLGSQGTSGRGGLGGQGAGMAAAAMGGAGQGGYGGLGSQGTS
GRGGLGGQGAGMAAAAMGGAGQGGYGGLGSQGTSGRGGLGGQGAGMAA
AAAMGGAGQGGYGGLGSQGTSGRGGLGGQGAGMAAAAMGGAGQGGYGG
LGSQGTSGRGGLGGQGAGMAAAAMGGAGQGGYGGLGSQGTSGRGGLGG
QGAGMAAAAMGGAGQGGYGGLGSQGTSGRGGLGGQGAGMAAAAMGGA
GQGGYGGLGSQGTSGRGGLGGQGAGMAAAAMGGAGQGGYGGLGSQGTS
GRGGLGGQGAGMAAAAMGGAGQGGYGGLGSQGTSGRGGLGGQGAGMAA
AAAMGGAGQGGYGGLGSQGTSGRGGLGGQGAGMAAAAMGGAGQGGYGG
LGSQGTSGRGGLGGQGAGMAAAAMGGAGQGGYGGLGSQGTSGRGGLGG
QGAGMAAAAMGGAGQGGYGGLGSQGTSGRGGLGGQGAGMAAAAMGGA
GQGGYGGLGSQGTSGRGGLGGQGAGMAAAAMGGAGQGGYGGLGSQGTS
GRGGLGGQGAGMAAAAMGGAGQGGYGGLGSQGTSGRGGLGGQGAGMAA
AAAMGGAGQGGYGGLGSQGTSGRGGLGGQGAGMAAAAMGGAGQGGYGG
LGSQGTSGRGGLGGQGAGMAAAAMGGAGQGGYGGLGSQGTSGRGGLGG
QGAGMAAAAMGGAGQGGYGGLGSQGTSGRGGLGGQGAGMAAAAMGGA
GQGGYGGLGSQGTSGRGGLGGQGAGMAAAAMGGAGQGGYGGLGSQGTS
GRGGLGGQGAGMAAAAMGGAGQGGYGGLGSQGTSGRGGLGGQGAGMAA
AAAMGGAGQGGYGGLGSQGTSGRGGLGGQGAGMAAAAMGGAGQGGYGG
LGSQGTSGRGGLGGQGAGMAAAAMGGAGQGGYGGLGSQGTSGRGGLGG
QGAGMAAAAMGGAGQGGYGGLGSQGTSGRGGLGGQGAGMAAAAMGGA
GQGGYGGLGSQGTSGRGGLGGQGAGMAAAAMGGAGQGGYGGLGSQGTS
GRGGLGGQGAGMAAAAMGGAGQGGYGGLGSQGTSGRGGLGGQGAGMAA
AAAMGGAGQGGYGGLGSQGTSGRGGLGGQGAGMAAAAMGGAGQGGYGG
LGSQGTSGRGGLGGQGAGMAAAAMGGAGQGGYGGLGSQGTSGRGGLGG
QGAGMAAAAMGGAGQGGYGGLGSQGTSGRGGLGGQGAGMAAAAMGGA
GQGGYGGLGSQGTSGRGGLGGQGAGMAAAAMGGAGQGGYGGLGSQGTS
GRGGLGGQGAGMAAAAMGGAGQGGYGGLGSQGTSGRGGLGGQGAGMAA
AAAMGGAGQGGYGGLGSQGTSGRGGLGGQGAGMAAAAMGGAGQGGYGG
LGSQGTSGRGGLGGQGAGMAAAAMGGAGQGGYGGLGSQGTSGRGGLGG
QGAGMAAAAMGGAGQGGYGGLGSQGTSGRGGLGGQGAGMAAAAMGGA
GQGGYGGLGSQGTSGGREF
```

2. Protein-Polymers—Cleavable Multipeptides (e.g. Signal-peptides, Cellular Adhesion Peptides with Nested Chemical or Enzymatic Cleavage Sites)

2.1 Peptide-Multimer: (RGDser-NG10)10 (182.1 kDa)
(100 repeat units of 17 AS monomer with hydroxylamine cleavage site (NG) for chemical cleavage)

DNA-sequence
(SEQ ID NO: 37)

```
ATGGTGCACCCGAGCTCTTCTGGTTGCGGTGGTAACTCTGAACCGCGTG
GTGACACCTACCGTGCTTACAACGGTTGCGGTGGTAACTCTGAACCGCG
TGGTGACACCTACCGTGCTTACAACGGTTGCGGTGGTAACTCTGAACCG
CGTGGTGACACCTACCGTGCTTACAACGGTTGCGGTGGTAACTCTGAAC
CGCGTGGTGACACCTACCGTGCTTACAACGGTTGCGGTGGTAACTCTGA
ACCGCGTGGTGACACCTACCGTGCTTACAACGGTTGCGGTGGTAACTCT
GAACCGCGTGGTGACACCTACCGTGCTTACAACGGTTGCGGTGGTAACT
CTGAACCGCGTGGTGACACCTACCGTGCTTACAACGGTTGCGGTGGTAA
CTCTGAACCGCGTGGTGACACCTACCGTGCTTACAACGGTTGCGGTGGT
AACTCTGAACCGCGTGGTGACACCTACCGTGCTTACAACGGTTGCGGTG
GTAACTCTGAACCGCGTGGTGACACCTACCGTGCTTACAACGGTTGCGG
TGGTAACTCTGAACCGCGTGGTGACACCTACCGTGCTTACAACGGTTGC
GGTGGTAACTCTGAACCGCGTGGTGACACCTACCGTGCTTACAACGGTT
GCGGTGGTAACTCTGAACCGCGTGGTGACACCTACCGTGCTTACAACGG
TTGCGGTGGTAACTCTGAACCGCGTGGTGACACCTACCGTGCTTACAAC
GGTTGCGGTGGTAACTCTGAACCGCGTGGTGACACCTACCGTGCTTACA
ACGGTTGCGGTGGTAACTCTGAACCGCGTGGTGACACCTACCGTGCTTA
CAACGGTTGCGGTGGTAACTCTGAACCGCGTGGTGACACCTACCGTGCT
TACAACGGTTGCGGTGGTAACTCTGAACCGCGTGGTGACACCTACCGTG
CTTACAACGGTTGCGGTGGTAACTCTGAACCGCGTGGTGACACCTACCG
TGCTTACAACGGTTGCGGTGGTAACTCTGAACCGCGTGGTGACACCTAC
CGTGCTTACAACGGTTGCGGTGGTAACTCTGAACCGCGTGGTGACACCT
ACCGTGCTTACAACGGTTGCGGTGGTAACTCTGAACCGCGTGGTGACAC
CTACCGTGCTTACAACGGTTGCGGTGGTAACTCTGAACCGCGTGGTGAC
ACCTACCGTGCTTACAACGGTTGCGGTGGTAACTCTGAACCGCGTGGTG
ACACCTACCGTGCTTACAACGGTTGCGGTGGTAACTCTGAACCGCGTGG
TGACACCTACCGTGCTTACAACGGTTGCGGTGGTAACTCTGAACCGCGT
GGTGACACCTACCGTGCTTACAACGGTTGCGGTGGTAACTCTGAACCGC
GTGGTGACACCTACCGTGCTTACAACGGTTGCGGTGGTAACTCTGAACC
GCGTGGTGACACCTACCGTGCTTACAACGGTTGCGGTGGTAACTCTGAA
CCGCGTGGTGACACCTACCGTGCTTACAACGGTTGCGGTGGTAACTCTG
AACCGCGTGGTGACACCTACCGTGCTTACAACGGTTGCGGTGGTAACTC
TGAACCGCGTGGTGACACCTACCGTGCTTACAACGGTTGCGGTGGTAAC
TCTGAACCGCGTGGTGACACCTACCGTGCTTACAACGGTTGCGGTGGTA
ACTCTGAACCGCGTGGTGACACCTACCGTGCTTACAACGGTTGCGGTGG
```

-continued

```
TAACTCTGAACCGCGTGGTGACACCTACCGTGCTTACAACGGTTGCGGT
GGTAACTCTGAACCGCGTGGTGACACCTACCGTGCTTACAACGGTTGCG
GTGGTAACTCTGAACCGCGTGGTGACACCTACCGTGCTTACAACGGTTG
CGGTGGTAACTCTGAACCGCGTGGTGACACCTACCGTGCTTACAACGGT
TGCGGTGGTAACTCTGAACCGCGTGGTGACACCTACCGTGCTTACAACG
GTTGCGGTGGTAACTCTGAACCGCGTGGTGACACCTACCGTGCTTACAA
CGGTTGCGGTGGTAACTCTGAACCGCGTGGTGACACCTACCGTGCTTAC
AACGGTTGCGGTGGTAACTCTGAACCGCGTGGTGACACCTACCGTGCTT
ACAACGGTTGCGGTGGTAACTCTGAACCGCGTGGTGACACCTACCGTGC
TTACAACGGTTGCGGTGGTAACTCTGAACCGCGTGGTGACACCTACCGT
GCTTACAACGGTTGCGGTGGTAACTCTGAACCGCGTGGTGACACCTACC
GTGCTTACAACGGTTGCGGTGGTAACTCTGAACCGCGTGGTGACACCTA
CCGTGCTTACAACGGTTGCGGTGGTAACTCTGAACCGCGTGGTGACACC
TACCGTGCTTACAACGGTTGCGGTGGTAACTCTGAACCGCGTGGTGACA
CCTACCGTGCTTACAACGGTTGCGGTGGTAACTCTGAACCGCGTGGTGA
CACCTACCGTGCTTACAACGGTTGCGGTGGTAACTCTGAACCGCGTGGT
GACACCTACCGTGCTTACAACGGTTGCGGTGGTAACTCTGAACCGCGTG
GTGACACCTACCGTGCTTACAACGGTTGCGGTGGTAACTCTGAACCGCG
TGGTGACACCTACCGTGCTTACAACGGTTGCGGTGGTAACTCTGAACCG
CGTGGTGACACCTACCGTGCTTACAACGGTTGCGGTGGTAACTCTGAAC
CGCGTGGTGACACCTACCGTGCTTACAACGGTTGCGGTGGTAACTCTGA
ACCGCGTGGTGACACCTACCGTGCTTACAACGGTTGCGGTGGTAACTCT
GAACCGCGTGGTGACACCTACCGTGCTTACAACGGTTGCGGTGGTAACT
CTGAACCGCGTGGTGACACCTACCGTGCTTACAACGGTTGCGGTGGTAA
CTCTGAACCGCGTGGTGACACCTACCGTGCTTACAACGGTTGCGGTGGT
AACTCTGAACCGCGTGGTGACACCTACCGTGCTTACAACGGTTGCGGTG
GTAACTCTGAACCGCGTGGTGACACCTACCGTGCTTACAACGGTTGCGG
TGGTAACTCTGAACCGCGTGGTGACACCTACCGTGCTTACAACGGTTGC
GGTGGTAACTCTGAACCGCGTGGTGACACCTACCGTGCTTACAACGGTT
GCGGTGGTAACTCTGAACCGCGTGGTGACACCTACCGTGCTTACAACGG
TTGCGGTGGTAACTCTGAACCGCGTGGTGACACCTACCGTGCTTACAAC
GGTTGCGGTGGTAACTCTGAACCGCGTGGTGACACCTACCGTGCTTACA
ACGGTTGCGGTGGTAACTCTGAACCGCGTGGTGACACCTACCGTGCTTA
CAACGGTTGCGGTGGTAACTCTGAACCGCGTGGTGACACCTACCGTGCT
TACAACGGTTGCGGTGGTAACTCTGAACCGCGTGGTGACACCTACCGTG
CTTACAACGGTTGCGGTGGTAACTCTGAACCGCGTGGTGACACCTACCG
TGCTTACAACGGTTGCGGTGGTAACTCTGAACCGCGTGGTGACACCTAC
CGTGCTTACAACGGTTGCGGTGGTAACTCTGAACCGCGTGGTGACACCT
ACCGTGCTTACAACGGTTGCGGTGGTAACTCTGAACCGCGTGGTGACAC
CTACCGTGCTTACAACGGTTGCGGTGGTAACTCTGAACCGCGTGGTGAC
ACCTACCGTGCTTACAACGGTTGCGGTGGTAACTCTGAACCGCGTGGTG
```

```
ACACCTACCGTGCTTACAACGGTTGCGGTGGTAACTCTGAACCGCGTGG

TGACACCTACCGTGCTTACAACGGTTGCGGTGGTAACTCTGAACCGCGT

GGTGACACCTACCGTGCTTACAACGGTTGCGGTGGTAACTCTGAACCGC

GTGGTGACACCTACCGTGCTTACAACGGTTGCGGTGGTAACTCTGAACC

GCGTGGTGACACCTACCGTGCTTACAACGGTTGCGGTGGTAACTCTGAA

CCGCGTGGTGACACCTACCGTGCTTACAACGGTTGCGGTGGTAACTCTG

AACCGCGTGGTGACACCTACCGTGCTTACAACGGTTGCGGTGGTAACTC

TGAACCGCGTGGTGACACCTACCGTGCTTACAACGGTTGCGGTGGTAAC

TCTGAACCGCGTGGTGACACCTACCGTGCTTACAACGGTTGCGGTGGTA

ACTCTGAACCGCGTGGTGACACCTACCGTGCTTACAACGGTTGCGGTGG

TAACTCTGAACCGCGTGGTGACACCTACCGTGCTTACAACGGTTGCGGT

GGTAACTCTGAACCGCGTGGTGACACCTACCGTGCTTACAACGGTTGCG

GTGGTAACTCTGAACCGCGTGGTGACACCTACCGTGCTTACAACGGTTG

CGGTGGTAACTCTGAACCGCGTGGTGACACCTACCGTGCTTACAACGGT

TGCGGTGGTAACTCTGAACCGCGTGGTGACACCTACCGTGCTTACAACG

GTTGCGGTGGTAACTCTGAACCGCGTGGTGACACCTACCGTGCTTACAA

CGGTTGCGGTGGTAACTCTGAACCGCGTGGTGACACCTACCGTGCTTAC

AACGGTTGCGGTGGTAACTCTGAACCGCGTGGTGACACCTACCGTGCTT

ACAACGGTTGCGGTGGTAACTCTGAACCGCGTGGTGACACCTACCGTGC

TTACAACGGTTGCGGTGGTAACTCTGAACCGCGTGGTGACACCTACCGT

GCTTACAACGGTTGCGGTGGTAACTCTGAACCGCGTGGTGACACCTACC

GTGCTTACAACGGTTGCGGTGGTAACTCTGAACCGCGTGGTGACACCTA

CCGTGCTTACAACGGTTGCGGTGGTAACTCTGAACCGCGTGGTGACACC

TACCGTGCTTACAACGGTTGCGGTGGTAACTCTGAACCGCGTGGTGACA

CCTACCGTGCTTACAACGGTTGCGGTGGTAACTCTGAACCGCGTGGTGA

CACCTACCGTGCTTACAACGGTTGCGGTGGTAACTCTGAACCGCGTGGT

GACACCTACCGTGCTTACAACGGTTGCGGTGGTAACTCTGAACCGCGTG

GTGACACCTACCGTGCTTACAACGGTTGCGGTGGTAACTCTGAACCGCG

TGGTGACACCTACCGTGCTTACAACGGTGGAAGAGGAATTCTCGAGCAC

CACCACCACCACCAC protein sequence
                                        (SEQ ID NO: 38)
MVHPSSSGCGGNSEPRGDTYRAYNGCGGNSEPRGDTYRAYNGCGGNSEP

RGDTYRAYNGCGGNSEPRGDTYRAYNGCGGNSEPRGDTYRAYNGCGGNS

EPRGDTYRAYNGCGGNSEPRGDTYRAYNGCGGNSEPRGDTYRAYNGCGG

NSEPRGDTYRAYNGCGGNSEPRGDTYRAYNGCGGNSEPRGDTYRAYNGC

GGNSEPRGDTYRAYNGCGGNSEPRGDTYRAYNGCGGNSEPRGDTYRAYN

GCGGNSEPRGDTYRAYNGCGGNSEPRGDTYRAYNGCGGNSEPRGDTYRA

YNGCGGNSEPRGDTYRAYNGCGGNSEPRGDTYRAYNGCGGNSEPRGDTY

RAYNGCGGNSEPRGDTYRAYNGCGGNSEPRGDTYRAYNGCGGNSEPRGD

TYRAYNGCGGNSEPRGDTYRAYNGCGGNSEPRGDTYRAYNGCGGNSEPR

GDTYRAYNGCGGNSEPRGDTYRAYNGCGGNSEPRGDTYRAYNGCGGNSE

PRGDTYRAYNGCGGNSEPRGDTYRAYNGCGGNSEPRGDTYRAYNGCGGN

SEPRGDTYRAYNGCGGNSEPRGDTYRAYNGCGGNSEPRGDTYRAYNGCG

GNSEPRGDTYRAYNGCGGNSEPRGDTYRAYNGCGGNSEPRGDTYRAYNG

CGGNSEPRGDTYRAYNGCGGNSEPRGDTYRAYNGCGGNSEPRGDTYRAY

NGCGGNSEPRGDTYRAYNGCGGNSEPRGDTYRAYNGCGGNSEPRGDTYR

AYNGCGGNSEPRGDTYRAYNGCGGNSEPRGDTYRAYNGCGGNSEPRGDT

YRAYNGCGGNSEPRGDTYRAYNGCGGNSEPRGDTYRAYNGCGGNSEPRG

DTYRAYNGCGGNSEPRGDTYRAYNGCGGNSEPRGDTYRAYNGCGGNSEP

RGDTYRAYNGCGGNSEPRGDTYRAYNGCGGNSEPRGDTYRAYNGCGGNS

EPRGDTYRAYNGCGGNSEPRGDTYRAYNGCGGNSEPRGDTYRAYNGCGG

NSEPRGDTYRAYNGCGGNSEPRGDTYRAYNGCGGNSEPRGDTYRAYNGC

GGNSEPRGDTYRAYNGCGGNSEPRGDTYRAYNGCGGNSEPRGDTYRAYN

GCGGNSEPRGDTYRAYNGCGGNSEPRGDTYRAYNGCGGNSEPRGDTYRA

YNGCGGNSEPRGDTYRAYNGCGGNSEPRGDTYRAYNGCGGNSEPRGDTY

RAYNGCGGNSEPRGDTYRAYNGCGGNSEPRGDTYRAYNGCGGNSEPRGD

TYRAYNGCGGNSEPRGDTYRAYNGCGGNSEPRGDTYRAYNGCGGNSEPR

GDTYRAYNGCGGNSEPRGDTYRAYNGCGGNSEPRGDTYRAYNGCGGNSE

PRGDTYRAYNGCGGNSEPRGDTYRAYNGCGGNSEPRGDTYRAYNGCGGN

SEPRGDTYRAYNGCGGNSEPRGDTYRAYNGCGGNSEPRGDTYRAYNGCG

GNSEPRGDTYRAYNGCGGNSEPRGDTYRAYNGCGGNSEPRGDTYRAYNG

CGGNSEPRGDTYRAYNGCGGNSEPRGDTYRAYNGCGGNSEPRGDTYRAY

NGCGGNSEPRGDTYRAYNGCGGNSEPRGDTYRAYNGCGGNSEPRGDTYR

AYNGCGGNSEPRGDTYRAYNGCGGNSEPRGDTYRAYNGCGGNSEPRGDT

YRAYNGCGGNSEPRGDTYRAYNGCGGNSEPRGDTYRAYNGCGGNSEPRG

DTYRAYNGCGGNSEPRGDTYRAYNGCGGNSEPRGDTYRAYNGGRGILEH

HHHHH
```

2.2 Peptide-Multimer: (RGDser-IEGR10)5 (104.9 kDa)
(50 repeat units of 19 AS monomer with Factor Xa protease recognition sequence (IEGR))

```
DNA-sequence
                                        (SEQ ID NO: 39)
ATGGTGCACCCGAGCTCTTCTGGTGGTAACGGTGAACCGCGTGGTGACA

CCTACCGTGCTTACATCGAAGGTCGTTGCGGTGGTAACGGTGAACCGCG

TGGTGACACCTACCGTGCTTACATCGAAGGTCGTTGCGGTGGTAACGGT

GAACCGCGTGGTGACACCTACCGTGCTTACATCGAAGGTCGTTGCGGTG

GTAACGGTGAACCGCGTGGTGACACCTACCGTGCTTACATCGAAGGTCG

TTGCGGTGGTAACGGTGAACCGCGTGGTGACACCTACCGTGCTTACATC

GAAGGTCGTTGCGGTGGTAACGGTGAACCGCGTGGTGACACCTACCGTG

CTTACATCGAAGGTCGTTGCGGTGGTAACGGTGAACCGCGTGGTGACAC

CTACCGTGCTTACATCGAAGGTCGTTGCGGTGGTAACGGTGAACCGCGT

GGTGACACCTACCGTGCTTACATCGAAGGTCGTTGCGGTGGTAACGGTG
```

-continued

```
AACCGCGTGGTGACACCTACCGTGCTTACATCGAAGGTCGTTGCGGTGG

TAACGGTGAACCGCGTGGTGACACCTACCGTGCTTACATCGAAGGTCGT

TGCGGTGGTAACGGTGAACCGCGTGGTGACACCTACCGTGCTTACATCG

AAGGTCGTTGCGGTGGTAACGGTGAACCGCGTGGTGACACCTACCGTGC

TTACATCGAAGGTCGTTGCGGTGGTAACGGTGAACCGCGTGGTGACACC

TACCGTGCTTACATCGAAGGTCGTTGCGGTGGTAACGGTGAACCGCGTG

GTGACACCTACCGTGCTTACATCGAAGGTCGTTGCGGTGGTAACGGTGA

ACCGCGTGGTGACACCTACCGTGCTTACATCGAAGGTCGTTGCGGTGGT

AACGGTGAACCGCGTGGTGACACCTACCGTGCTTACATCGAAGGTCGTT

GCGGTGGTAACGGTGAACCGCGTGGTGACACCTACCGTGCTTACATCGA

AGGTCGTTGCGGTGGTAACGGTGAACCGCGTGGTGACACCTACCGTGCT

TACATCGAAGGTCGTTGCGGTGGTAACGGTGAACCGCGTGGTGACACCT

ACCGTGCTTACATCGAAGGTCGTTGCGGTGGTAACGGTGAACCGCGTGG

TGACACCTACCGTGCTTACATCGAAGGTCGTTGCGGTGGTAACGGTGAA

CCGCGTGGTGACACCTACCGTGCTTACATCGAAGGTCGTTGCGGTGGTA

ACGGTGAACCGCGTGGTGACACCTACCGTGCTTACATCGAAGGTCGTTG

CGGTGGTAACGGTGAACCGCGTGGTGACACCTACCGTGCTTACATCGAA

GGTCGTTGCGGTGGTAACGGTGAACCGCGTGGTGACACCTACCGTGCTT

ACATCGAAGGTCGTTGCGGTGGTAACGGTGAACCGCGTGGTGACACCTA

CCGTGCTTACATCGAAGGTCGTTGCGGTGGTAACGGTGAACCGCGTGGT

GACACCTACCGTGCTTACATCGAAGGTCGTTGCGGTGGTAACGGTGAAC

CGCGTGGTGACACCTACCGTGCTTACATCGAAGGTCGTTGCGGTGGTAA

CGGTGAACCGCGTGGTGACACCTACCGTGCTTACATCGAAGGTCGTTGC

GGTGGTAACGGTGAACCGCGTGGTGACACCTACCGTGCTTACATCGAAG

GTCGTTGCGGTGGTAACGGTGAACCGCGTGGTGACACCTACCGTGCTTA

CATCGAAGGTCGTTGCGGTGGTAACGGTGAACCGCGTGGTGACACCTAC

CGTGCTTACATCGAAGGTCGTTGCGGTGGTAACGGTGAACCGCGTGGTG

ACACCTACCGTGCTTACATCGAAGGTCGTTGCGGTGGTAACGGTGAACC

GCGTGGTGACACCTACCGTGCTTACATCGAAGGTCGTTGCGGTGGTAAC

GGTGAACCGCGTGGTGACACCTACCGTGCTTACATCGAAGGTCGTTGCG

GTGGTAACGGTGAACCGCGTGGTGACACCTACCGTGCTTACATCGAAGG

TCGTTGCGGTGGTAACGGTGAACCGCGTGGTGACACCTACCGTGCTTAC

ATCGAAGGTCGTTGCGGTGGTAACGGTGAACCGCGTGGTGACACCTACC

GTGCTTACATCGAAGGTCGTTGCGGTGGTAACGGTGAACCGCGTGGTGA

CACCTACCGTGCTTACATCGAAGGTCGTTGCGGTGGTAACGGTGAACCG

CGTGGTGACACCTACCGTGCTTACATCGAAGGTCGTTGCGGTGGTAACG

GTGAACCGCGTGGTGACACCTACCGTGCTTACATCGAAGGTCGTTGCGG

TGGTAACGGTGAACCGCGTGGTGACACCTACCGTGCTTACATCGAAGGT

CGTTGCGGTGGTAACGGTGAACCGCGTGGTGACACCTACCGTGCTTACA

TCGAAGGTCGTTGCGGTGGTAACGGTGAACCGCGTGGTGACACCTACCG

TGCTTACATCGAAGGTCGTTGCGGTGGTAACGGTGAACCGCGTGGTGAC

ACCTACCGTGCTTACATCGAAGGTCGTTGCGGTGGTAACGGTGAACCGC

GTGGTGACACCTACCGTGCTTACATCGAAGGTCGTTGCGGTGGTAACGG

TGAACCGCGTGGTGACACCTACCGTGCTTACATCGAAGGTCGTTGCGGT

GGTAACGGTGAACCGCGTGGTGACACCTACCGTGCTTACATCGAAGGTC

GTTGCGGTGGTAACGGTGAACCGCGTGGTGACACCTACCGTGCTTACAT

CGAAGGTCGTTGCGGTGGTAACGGTGAACCGCGTGGTGACACCTACCGT

GCTTACATCGAAGGTCGTTGCGGTGGTAACGGTGAACCGCGTGGTGACA

CCTACCGTGCTTACATCGAAGGTCGTTGCGGTGGAAGAGGAATTCTCGA

GCACCACCACCACCACCAC
``` protein sequence (SEQ ID NO: 40)

```
MVHPSSSGGNGEPRGDTYRAYIEGRCGGNGEPRGDTYRAYIEGRCGGNG

EPRGDTYRAYIEGRCGGNGEPRGDTYRAYIEGRCGGNGEPRGDTYRAYI

EGRCGGNGEPRGDTYRAYIEGRCGGNGEPRGDTYRAYIEGRCGGNGEPR

GDTYRAYIEGRCGGNGEPRGDTYRAYIEGRCGGNGEPRGDTYRAYIEGR

CGGNGEPRGDTYRAYIEGRCGGNGEPRGDTYRAYIEGRCGGNGEPRGDT

YRAYIEGRCGGNGEPRGDTYRAYIEGRCGGNGEPRGDTYRAYIEGRCGG

NGEPRGDTYRAYIEGRCGGNGEPRGDTYRAYIEGRCGGNGEPRGDTYRA

YIEGRCGGNGEPRGDTYRAYIEGRCGGNGEPRGDTYRAYIEGRCGGNGE

PRGDTYRAYIEGRCGGNGEPRGDTYRAYIEGRCGGNGEPRGDTYRAYIE

GRCGGNGEPRGDTYRAYIEGRCGGNGEPRGDTYRAYIEGRCGGNGEPRG

DTYRAYIEGRCGGNGEPRGDTYRAYIEGRCGGNGEPRGDTYRAYIEGRC

GGNGEPRGDTYRAYIEGRCGGNGEPRGDTYRAYIEGRCGGNGEPRGDTY

RAYIEGRCGGNGEPRGDTYRAYIEGRCGGNGEPRGDTYRAYIEGRCGGN

GEPRGDTYRAYIEGRCGGNGEPRGDTYRAYIEGRCGGNGEPRGDTYRAY

IEGRCGGNGEPRGDTYRAYIEGRCGGNGEPRGDTYRAYIEGRCGGNGEP

RGDTYRAYIEGRCGGNGEPRGDTYRAYIEGRCGGNGEPRGDTYRAYIEG

RCGGNGEPRGDTYRAYIEGRCGGNGEPRGDTYRAYIEGRCGGNGEPRGD

TYRAYIEGRCGGNGEPRGDTYRAYIEGRCGGNGEPRGDTYRAYIEGRCG

GNGEPRGDTYRAYIEGRCGGNGEPRGDTYRAYIEGRCGGNGEPRGDTYR

AYIEGRCGGNGEPRGDTYRAYIEGRCGGRGILEHHHHHH
```

2.3 Peptide-Multimer: (NCAMenc-TEV10)1 (28.9 kDa) (10 repeat units of 24 AS monomer with TEV protease recognition sequence (ENLYFQ))

DNA-sequence (SEQ ID NO: 41)

```
ATGGTGCACCCGAGCTCTTCTGGCTGCGGCGGCACCATTATGGGCCTGA

AACCGGAAACCCGCTATGCGGTGCGCGAAAACCTGTACTTTCAGGGCTG

CGGCGGCACCATTATGGGCCTGAAACCGGAAACCCGCTATGCGGTGCGC

GAAAACCTGTACTTTCAGGGCTGCGGCGGCACCATTATGGGCCTGAAAC

CGGAAACCCGCTATGCGGTGCGCGAAAACCTGTACTTTCAGGGCTGCGG

CGGCACCATTATGGGCCTGAAACCGGAAACCCGCTATGCGGTGCGCGAA
```

```
AACCTGTACTTTCAGGGCTGCGGCGGCACCATTATGGGCCTGAAACCGG

AAACCCGCTATGCGGTGCGCGAAAACCTGTACTTTCAGGGCTGCGGCGG

CACCATTATGGGCCTGAAACCGGAAACCCGCTATGCGGTGCGCGAAAAC

CTGTACTTTCAGGGCTGCGGCGGCACCATTATGGGCCTGAAACCGGAAA

CCCGCTATGCGGTGCGCGAAAACCTGTACTTTCAGGGCTGCGGCGGCAC

CATTATGGGCCTGAAACCGGAAACCCGCTATGCGGTGCGCGAAAACCTG

TACTTTCAGGGCTGCGGCGGCACCATTATGGGCCTGAAACCGGAAACCC

GCTATGCGGTGCGCGAAAACCTGTACTTTCAGGGCTGCGGCGGCACCAT
```

```
TATGGGCCTGAAACCGGAAACCCGCTATGCGGTGCGCGAAAACCTGTAC

TTTCAGGGTGGAAGAGGAATTCACCACCACCACCACCAC protein sequence
                                            (SEQ ID NO: 42)
MVHPSSSGCGGTIMGLKPETRYAVRENLYFQGCGGTIMGLKPETRYAVR

ENLYFQGCGGTIMGLKPETRYAVRENLYFQGCGGTIMGLKPETRYAVRE

NLYFQGCGGTIMGLKPETRYAVRENLYFQGCGGTIMGLKPETRYAVREN

LYFQGCGGTIMGLKPETRYAVRENLYFQGCGGTIMGLKPETRYAVRENL

YFQGCGGTIMGLKPETRYAVRENLYFQGCGGTIMGLKPETRYAVRENLY

FQGGRGIHHHHHH
```

SEQUENCE LISTING (129 sequences)

SEQ ID NO: 1 - DNA, 366 bp, Artificial Sequence
  Synthetic
atgactgcagggagctcttctggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtggaagagaagcttggatcctcgagcaccaccaccaccaccac

SEQ ID NO: 2 - protein, 122 aa, Artificial Sequence
  Synthetic
MTAGSSSGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGGREAWILEHHHHHH

SEQ ID NO: 3 - DNA, 1566 bp, Artificial Sequence
  Synthetic
atgactgcagggagctcttctggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtggaagagaagcttggatcctcgagcaccaccaccaccaccac

SEQ ID NO: 4 - protein, 522 aa, Artificial Sequence
  Synthetic
MTAGSSSGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGGREAWILEHHHHHH

SEQ ID NO: 5 - DNA, 354 bp, Artificial Sequence
  Synthetic
atggtgcacccgagctcttctggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtggaagaggaattcaccaccaccaccaccac

SEQ ID NO: 6 - protein, 118 aa, Artificial Sequence
  Synthetic
MVHPSSSGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGGRGIHHHHHH

SEQ ID NO: 7 - DNA, 1554 bp, Artificial Sequence
  Synthetic
atggtgcacccgagctcttctggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtggaagaggaattcaccaccaccaccaccac

SEQ ID NO: 8 - protein, 518 aa, Artificial Sequence
  Synthetic
MVHPSSSGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGGRGIHHHHHH

SEQ ID NO: 9 - DNA, 1686 bp, Artificial Sequence
  Synthetic
atgactgcagggagctcttctggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaagggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtggaagagaagcttggatcctcgagcaccaccaccaccaccac

SEQ ID NO: 10 - protein, 562 aa, Artificial Sequence
  Synthetic
MTAGSSSGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGMVSKGEELFTGVVPILVELDGDVNGHKFSVSGEGEGDATYGKLTLKFICTTGKLPVPWPTLVTTFGYGLQCFARYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYKGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGGREAWILEHHHHHH

SEQ ID NO: 11 - DNA, 2100 bp, Artificial Sequence
  Synthetic
atggtgcacccgagctcttctggtatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaagggtggaagaggaattctcgagcaccaccaccaccaccac

SEQ ID NO: 12 - protein, 700 aa, Artificial Sequence
  Synthetic
MVHPSSSGMVSKGEELFTGVVPILVELDGDVNGHKFSVSGEGEGDATYGKLTLKFICTTGKLPVPWPTLVTTLTWGVQCFSRYPDHMKQHDFFKSAMPEGYVQERTIFFKDDGNYKTRAEVKFEGDTLVNRIELKGIDFKEDGNILGHKLEYNYISHNVYITADKQKNGIKANFKIRHNIEDGSVQLADHYQQNTPIGDGPVLLPDNHYLSTQSALSKDPNEKRDHMVLLEFVTAAGITLGMDELYKGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGMVSKGEELFTGVVPILVELDGDVNGHKFSVSGEGEGDATYGKLTLKFICTTGKLPVPWPTLVTTFGYGLQCFARYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYKGGRGILEHHHHHH

SEQ ID NO: 13 - DNA, 399 bp, Artificial Sequence
  Synthetic
atgggcagcagccatcatcatcatcatcacagcagcggcctggtgccgcgcggcagccatatggccatgggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggttgcggtggaagagaattc

SEQ ID NO: 14 - protein, 133 aa, Artificial Sequence
  Synthetic
MGSSHHHHHHSSGLVPRGSHMAMGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGGREF

SEQ ID NO: 15 - DNA, 399 bp, Artificial Sequence
  Synthetic
atgggcagcagccatcatcatcatcatcacagcagcggcctggtgccgcgcggcagccatatggccatgggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggttgcggtggaagagaattc

SEQ ID NO: 16 - protein, 133 aa, Artificial Sequence
  Synthetic
MGSSHHHHHHSSGLVPRGSHMAMGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGCGGREF

SEQ ID NO: 17 - DNA, 663 bp, Artificial Sequence
  Synthetic
atgggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggttgcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtggaagagaattggccgcactcgagcaccaccaccaccaccac

SEQ ID NO: 18 - protein, 221 aa, Artificial Sequence
  Synthetic
MGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGCGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGGRELAALEHHHHHH

SEQ ID NO: 19 - DNA, 768 bp, Artificial Sequence
  Synthetic
atgggcagcagccatcatcatcatcatcacagcagcggcctggtgccgcgcggcagccatatggccatgggctcttctggtgttccgggtgttggtgttccgggtgttggtgttccgggttacggtgttccgggtgttggtgttccgggtgttggtgttccgggttacggtgttccgggtgttggtgttccgggtgttggtgttccgggttacggtgttccgggtgttggtgttccgggtgttggtgttccgggttacggtgttccgggtgttggtgttccgggtgttggtgttccgggttacggtgttccgggtgttggtgttccgggtgttggtgttccgggttacggtgttccgggtgttggtgttccgggtgttggtgttccgggttacggtgttccgggtgttggtgttccgggtgttggtgttccgggttacggtgttccgggtgttggtgttccgggtgttggtgttccgggttacggtgttccgggtgttggtgttccgggtgttggtgttccgggttacggtgttccgggtgttggtgttccgggtgttggtgttccgggttacggtgttccgggtgttggtgttccgggtgttggtgttccgggttacggtgttccgggtgttggtgttccgggtgttggtgttccgggttacggtgttccgggtgttggtgttccgggtgttggtgttccgggttacggtgttccgggtgttggtgttccgggtgttggtgttccgggttacggtggaagagaattc

SEQ ID NO: 20 - protein, 256 aa, Artificial Sequence
  Synthetic
MGSSHHHHHHSSGLVPRGSHMAMGSSGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGGREF

SEQ ID NO: 21 - DNA, 954 bp, Artificial Sequence
  Synthetic
atggtgcacccgagctcttctggtgttccgggtgttggtgttccgggtgttggtgttccgggttgcggtgttccgggtgttggtgttccgggtgttggtgttccgggttgcggtgttccgggtgttggtgttccgggtgttggtgttccgggttgcggtgttccgggtgttggtgttccgggtgttggtgttccgggttgcggtgttccgggtgttggtgttccgggtgttggtgttccgggttgcggtgttccgggtgttggtgttccgggtgttggtgttccgggttgcggtgttccgggtgttggtgttccgggtgttggtgttccgggttgcggtgttccgggtgttggtgttccgggtgttggtgttccgggttgcggtgttccgggtgttggtgttccgggtgttggtgttccgggttgcggtgttccgggtgttggtgttccgggtgttggtgttccgggttgcggtgttccgggtgttggtgttccgggtgttggtgttccgggttgcggtgttccgggtgttggtgttccgggtgttggtgttccgggttgcggtgttccgggtgttggtgttccgggtgttggtgttccgggttgcggtgttccgggtgttggtgttccgggtgttggtgttccgggttgcggtgttccgggtgttggtgttccgggtgttggtgttccgggttgcggtgttccgggtgttggtgttccgggtgttggtgttccgggttgcggtgttccgggtgttggtgttccgggtgttggtgttccgggttgcggtgttccgggtgttggtgttccgggtgttggtgttccgggttgcggtgttccgggtgttggtgttccgggtgttggtgttccgggttgcggtgttccgggtgttggtgttccgggtgttggtgttccgggttgcggtggaagaggaattcaccaccaccaccaccac

SEQ ID NO: 22 - protein, 318 aa, Artificial Sequence
  Synthetic
MVHPSSSGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGGRGIHHHHHH

SEQ ID NO: 23 - DNA, 618 bp, Artificial Sequence
  Synthetic
atgggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtggaagagaattc

SEQ ID NO: 24 - protein, 206 aa, Artificial Sequence
  Synthetic
MGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGGREF

SEQ ID NO: 25 - DNA, 918 bp, Artificial Sequence
  Synthetic
atgggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtagaggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtggaagagaattc

SEQ ID NO: 26 - protein, 306 aa, Artificial Sequence
  Synthetic
MGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGGREF

SEQ ID NO: 27 - DNA, 618 bp, Artificial Sequence
  Synthetic
atgggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtggaagagaattc

SEQ ID NO: 28 - protein, 206 aa, Artificial Sequence
  Synthetic
MGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGGREF

SEQ ID NO: 29 - DNA, 1395 bp, Artificial Sequence
  Synthetic
atggtgcacccgagctcttctggtatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaaggcggccgcaaccggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtggaagagaattgatcctcgagcaccaccaccaccaccac

SEQ ID NO: 30 - protein, 465 aa, Artificial Sequence
  Synthetic
MVHPSSSGMVSKGEELFTGVVPILVELDGDVNGHKFSVSGEGEGDATYGKLTLKFICTTGKLPVPWPTLVTTFGYGLQCFARYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYKAAATGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGGRELILEHHHHHH

SEQ ID NO: 31 - DNA, 2466 bp, Artificial Sequence
  Synthetic
atgactgcagggagctcttctggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtttcggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtgttccgggtgaaggtggaagagaattccggccgatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccaagctgagcaaagaccccaacgagaagcgcgatcacatggtcctgctggagttcgtgaccgccgccgggatcactctcggcatggacgagctgtacaaggcggccgcaaccggtggaagagaagcttggatcctcgagcaccaccaccaccaccac

SEQ ID NO: 32 - protein, 822 aa, Artificial Sequence
  Synthetic
MTAGSSSGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGVPGEGGREFRPMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSKLSKDPNEKRDHMVLLEFVTAAGITLGMDELYKAAATGGREAWILEHHHHHH

SEQ ID NO: 33 - DNA, 1395 bp, Artificial Sequence
  Synthetic
atgggtggtcgaccttctgattcttacggtgctcctggtggtggtaatggtggtcgaccttctgattcttacggtgctcctggtggtggtaatggtggtcgaccttctgattcttacggtgctcctggtggtggtaatggtggtcgaccttctgattcttacggtgctcctggtggtggtaatggtggtcgaccttctgattcttacggtgctcctggtggtggtaatggtggtcgaccttctgattcttacggtgctcctggtggtggtaatggtggtcgaccttctgattcttacggtgctcctggtggtggtaatggtggtcgaccttctgattcttacggtgctcctggtggtggtaatggtggtcgaccttctgattcttacggtgctcctggtggtggtaatggtggtcgaccttctgattcttacggtgctcctggtggtggtaatggtggtcgaccttctgattcttacggtgctcctggtggtggtaatggtggtcgaccttctgattcttacggtgctcctggtggtggtaatggtggtcgaccttctgattcttacggtgctcctggtggtggtaatggtggtcgaccttctgattcttacggtgctcctggtggtggtaatggtggtcgaccttctgattcttacggtgctcctggtggtggtaatggtggtcgaccttctgattcttacggtgctcctggtggtggtaatggtggtcgaccttctgattcttacggtgctcctggtggtggtaatggtggtcgaccttctgattcttacggtgctcctggtggtggtaatggtggtcgaccttctgattcttacggtgctcctggtggtggtaatggtggtcgaccttctgattcttacggtgctcctggtggtggtaatggtggtcgaccttctgattcttacggtgctcctggtggtggtaatggtggtcgaccttctgattcttacggtgctcctggtggtggtaatggtggtcgaccttctgattcttacggtgctcctggtggtggtaatggtggtcgaccttctgattcttacggtgctcctggtggtggtaatggtggtcgaccttctgattcttacggtgctcctggtggtggtaatggtggtcgaccttctgattcttacggtgctcctggtggtggtaatggtggtcgaccttctgattcttacggtgctcctggtggtggtaatggtggtcgaccttctgattcttacggtgctcctggtggtggtaatggtggtcgaccttctgattcttacggtgctcctggtggtggtaatggtggtcgaccttctgattcttacggtgctcctggtggtggtaatggtggaagagaattgatcctcgagcaccaccaccaccaccac

SEQ ID NO: 34 - protein, 465 aa, Artificial Sequence
  Synthetic
MGGRPSDSYGAPGGGNGGRPSDSYGAPGGGNGGRPSDSYGAPGGGNGGRPSDSYGAPGGGNGGRPSDSYGAPGGGNGGRPSDSYGAPGGGNGGRPSDSYGAPGGGNGGRPSDSYGAPGGGNGGRPSDSYGAPGGGNGGRPSDSYGAPGGGNGGRPSDSYGAPGGGNGGRPSDSYGAPGGGNGGRPSDSYGAPGGGNGGRPSDSYGAPGGGNGGRPSDSYGAPGGGNGGRPSDSYGAPGGGNGGRPSDSYGAPGGGNGGRPSDSYGAPGGGNGGRPSDSYGAPGGGNGGRPSDSYGAPGGGNGGRPSDSYGAPGGGNGGRPSDSYGAPGGGNGGRPSDSYGAPGGGNGGRPSDSYGAPGGGNGGRPSDSYGAPGGGNGGRPSDSYGAPGGGNGGRPSDSYGAPGGGNGGRPSDSYGAPGGGNGGRPSDSYGAPGGGNGGRPSDSYGAPGGGNGGRELILEHHHHHH

SEQ ID NO: 35 - DNA, 8436 bp, Artificial Sequence
  Synthetic
atgactgcagggagctcttctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtcgtggtggtctgggtggtcagggtgctggtatggctgctgctgctgctatgggtggtgctggtcagggtggttacggtggtctgggttctcagggtacctctggtggaagagaattc

SEQ ID NO: 36 - protein, 2812 aa, Artificial Sequence
  Synthetic
MTAGSSSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGRGGLGGQGAGMAAAAAMGGAGQGGYGGLGSQGTSGGREF

SEQ ID NO: 37 - DNA, 5160 bp, Artificial Sequence
  Synthetic
atggtgcacccgagctcttctggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggttgcggtggtaactctgaaccgcgtggtgacacctaccgtgcttacaacggtggaagaggaattctcgagcaccaccaccaccaccac

SEQ ID NO: 38 - protein, 1720 aa, Artificial Sequence
  Synthetic
MVHPSSSGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGGRGILEHHHHHH

SEQ ID NO: 39 - DNA, 2910 bp, Artificial Sequence
  Synthetic
atggtgcacccgagctcttctggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggtaacggtgaaccgcgtggtgacacctaccgtgcttacatcgaaggtcgttgcggtggaagaggaattctcgagcaccaccaccaccaccac

SEQ ID NO: 40 - protein, 970 aa, Artificial Sequence
  Synthetic
MVHPSSSGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGNGEPRGDTYRAYIEGRCGGRGILEHHHHHH

SEQ ID NO: 41 - DNA, 774 bp, Artificial Sequence
  Synthetic
atggtgcacccgagctcttctggctgcggcggcaccattatgggcctgaaaccggaaacccgctatgcggtgcgcgaaaacctgtactttcagggctgcggcggcaccattatgggcctgaaaccggaaacccgctatgcggtgcgcgaaaacctgtactttcagggctgcggcggcaccattatgggcctgaaaccggaaacccgctatgcggtgcgcgaaaacctgtactttcagggctgcggcggcaccattatgggcctgaaaccggaaacccgctatgcggtgcgcgaaaacctgtactttcagggctgcggcggcaccattatgggcctgaaaccggaaacccgctatgcggtgcgcgaaaacctgtactttcagggctgcggcggcaccattatgggcctgaaaccggaaacccgctatgcggtgcgcgaaaacctgtactttcagggctgcggcggcaccattatgggcctgaaaccggaaacccgctatgcggtgcgcgaaaacctgtactttcagggctgcggcggcaccattatgggcctgaaaccggaaacccgctatgcggtgcgcgaaaacctgtactttcagggctgcggcggcaccattatgggcctgaaaccggaaacccgctatgcggtgcgcgaaaacctgtactttcagggctgcggcggcaccattatgggcctgaaaccggaaacccgctatgcggtgcgcgaaaacctgtactttcagggtggaagaggaattcaccaccaccaccaccac

SEQ ID NO: 42 - protein, 258 aa, Artificial Sequence
  Synthetic
MVHPSSSGCGGTIMGLKPETRYAVRENLYFQGCGGTIMGLKPETRYAVRENLYFQGCGGTIMGLKPETRYAVRENLYFQGCGGTIMGLKPETRYAVRENLYFQGCGGTIMGLKPETRYAVRENLYFQGCGGTIMGLKPETRYAVRENLYFQGCGGTIMGLKPETRYAVRENLYFQGCGGTIMGLKPETRYAVRENLYFQGCGGTIMGLKPETRYAVRENLYFQGCGGTIMGLKPETRYAVRENLYFQGGRGIHHHHHH

SEQ ID NO: 43 - protein, 12 aa, Artificial Sequence
  Synthetic
AASIKVAVSADR

SEQ ID NO: 44 - protein, 19 aa, Artificial Sequence
  Synthetic
CSRARKQAASIKVAVSADR

SEQ ID NO: 45 - protein, 20 aa, Artificial Sequence
  Synthetic
GEEIQIGHIPREDVDYHLYP

SEQ ID NO: 46 - protein, 24 aa, Artificial Sequence
  Synthetic
TAQQTTKLKLDAPTNLQFVNETDS

SEQ ID NO: 47 - protein, 21 aa, Artificial Sequence
  Synthetic
ITVYAVTGRGDSPASSKPISI

SEQ ID NO: 48 - protein, 15 aa, Artificial Sequence
  Synthetic
GVKGDKGNPGWPGAP

SEQ ID NO: 49 - protein, 8 aa, Artificial Sequence
  Synthetic
VFDNFVLK

SEQ ID NO: 50 - protein, 11 aa, Artificial Sequence
  Synthetic
ASKKPKRNIKA

SEQ ID NO: 51 - protein, 15 aa, Artificial Sequence
  Synthetic
NLIKQDDGGSPIRHY

SEQ ID NO: 52 - protein, 15 aa, Artificial Sequence
  Synthetic
EVYVVAENQQGKSKA

SEQ ID NO: 53 - protein, 15 aa, Artificial Sequence
  Synthetic
NLIKQDDGGSPIRHY

SEQ ID NO: 54 - protein, 14 aa, Artificial Sequence
  Synthetic
TIMGLKPETRYAVR

SEQ ID NO: 55 - protein, 13 aa, Artificial Sequence
  Synthetic
GEFYFDLRLKGDK

SEQ ID NO: 56 - protein, 5 aa, Artificial Sequence
  Synthetic
  misc_feature (4)..(4): Xaa is D-phenylalanine
  misc_feature (5)..(5): Xaa is N-methyl-valine
RGDXX

SEQ ID NO: 57 - protein, 5 aa, Artificial Sequence
  Synthetic
RGDNV

SEQ ID NO: 58 - protein, 17 aa, Artificial Sequence
  Synthetic
GCGGNSEPRGDTYRAYN

SEQ ID NO: 59 - protein, 19 aa, Artificial Sequence
  Synthetic
CGGNGEPRGDTYRAYIEGR

SEQ ID NO: 60 - protein, 19 aa, Artificial Sequence
  Synthetic
CGGNGEPRGDTYRAYLVPR

SEQ ID NO: 61 - protein, 21 aa, Artificial Sequence
  Synthetic
GCGNGEPRGDTYRAYENLYFQ

SEQ ID NO: 62 - protein, 25 aa, Artificial Sequence
  Synthetic
GCGGGEEIQIGHIPREDVDYHLYPN

SEQ ID NO: 63 - protein, 20 aa, Artificial Sequence
  Synthetic
GCGGEVYVVAENQQGKSKAN

SEQ ID NO: 64 - protein, 24 aa, Artificial Sequence
  Synthetic
GCGGTIMGLKPETRYAVRENLYFQ

SEQ ID NO: 65 - protein, 10 aa, Artificial Sequence
  Synthetic
GFDFDFDFDN

SEQ ID NO: 66 - protein, 14 aa, Artificial Sequence
  Synthetic
GAYSSGAPPMPPFN

SEQ ID NO: 67 - protein, 14 aa, Artificial Sequence
  Synthetic
GLSTVQTISPSNHN

SEQ ID NO: 68 - protein, 359 aa, Artificial Sequence
  Synthetic
VHPSSSGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGGRGILEHHHHHH

SEQ ID NO: 69 - DNA, 45 bp, Artificial Sequence
  Synthetic
ggtggtcgaccttctgattcttacggtgctcctggtggtggtaat

SEQ ID NO: 70 - DNA, 45 bp, Artificial Sequence
  Synthetic
accattaccaccaccaggagcaccgtaagaatcagaaggtcgacc

SEQ ID NO: 71 - DNA, 50 bp, Artificial Sequence
  Synthetic
ggtcgtggtggtctgggtggtcagggtgctggtatggctgctgctgctgc

SEQ ID NO: 72 - DNA, 55 bp, Artificial Sequence
  Synthetic
tatgggtggtgctggtcagggtggttacggtggtctgggttctcagggtacctct

SEQ ID NO: 73 - DNA, 60 bp, Artificial Sequence
  Synthetic
agcaccacccatagcagcagcagcagccataccagcaccctgaccacccagaccaccacg

SEQ ID NO: 74 - DNA, 45 bp, Artificial Sequence
  Synthetic
accagaggtaccctgagaacccagaccaccgtaaccaccctgacc

SEQ ID NO: 75 - protein, 200 aa, Artificial Sequence
  Synthetic
VPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVG

SEQ ID NO: 76 - protein, 300 aa, Artificial Sequence
  Synthetic
VPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVG

SEQ ID NO: 77 - protein, 400 aa, Artificial Sequence
  Synthetic
VPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVG

SEQ ID NO: 78 - protein, 3000 aa, Artificial Sequence
  Synthetic
VPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVG

SEQ ID NO: 79 - DNA, 9000 bp, Artificial Sequence
  Synthetic
gttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggtgttccgggtgttggt

SEQ ID NO: 80 - protein, 100 aa, Artificial Sequence
  Synthetic
VPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVG

SEQ ID NO: 81 - protein, 500 aa, Artificial Sequence
  Synthetic
VPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVG

SEQ ID NO: 82 - protein, 100 aa, Artificial Sequence
  Synthetic
VPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRG

SEQ ID NO: 83 - protein, 100 aa, Artificial Sequence
  Synthetic
VPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFG

SEQ ID NO: 84 - protein, 200 aa, Artificial Sequence
  Synthetic
VPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFG

SEQ ID NO: 85 - protein, 106 aa, Artificial Sequence
  Synthetic
HVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCG

SEQ ID NO: 86 - protein, 106 aa, Artificial Sequence
  Synthetic
HVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGCG

SEQ ID NO: 87 - protein, 105 aa, Artificial Sequence
  Synthetic
VPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGCG

SEQ ID NO: 88 - protein, 85 aa, Artificial Sequence
  Synthetic
VPGVGVPGVGVPGYGVPGYGVPGYGVPGYGVPGYGVPGYGVPGYGVPGYGVPGYGVPGYGVPGYGVPGYGVPGYGVPGYGVPGYG

SEQ ID NO: 89 - protein, 200 aa, Artificial Sequence
  Synthetic
VPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGRGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFGVPGFG

SEQ ID NO: 90 - DNA, 15 bp, Artificial Sequence
  Synthetic
ggtgttccgggtgtt

SEQ ID NO: 91 - DNA, 15 bp, Artificial Sequence
  Synthetic
accaacacccggaac

SEQ ID NO: 92 - protein, 15 aa, Artificial Sequence
  Synthetic
GGRPSDSYGAPGGGN

SEQ ID NO: 93 - protein, 5 aa, Artificial Sequence
  Synthetic
  misc_feature (4)..(4): Xaa is Val, Ile or Ala
VPGXG

SEQ ID NO: 94 - protein, 5 aa, Artificial Sequence
  Synthetic
  misc_feature (1)..(1): Xaa is Val, Leu or Ala
  misc_feature (4)..(4): Xaa is Val, Leu or Ala
XGGXG

SEQ ID NO: 95 - protein, 14 aa, Artificial Sequence
  Synthetic
  misc_feature: Further description regarding the repeating sequence variables of the formula can be found in the specification
  misc_feature (2)..(2): Xaa, if present, is Ala or Gly
  misc_feature (4)..(4): Xaa, if present, is Ala or Gly
  misc_feature (6)..(6): Xaa is Glu, Asp, Arg, Val, Lys, His, Ser, Thr, Asn or Gln, or is a mixture thereof
  misc_feature (9)..(9): Xaa, if present, is Ala or Gly
  misc_feature (11)..(11): Xaa, if present, is Ala or Gly
  misc_feature (13)..(13): Xaa is Tyr, Cys, Phe, Ile, Leu, Met, Val or Trp, or is a mixture thereof
VXPXGXGVXPXGXG

SEQ ID NO: 96 - protein, 10 aa, Artificial Sequence
  Synthetic
  misc_feature: Further description regarding the repeating sequence variables of the formula can be found in the specification
  misc_feature (9)..(9): Xaa is Tyr, Cys or Trp
VPGVGVPGXG

SEQ ID NO: 97 - protein, 187500 aa, Artificial Sequence
  Synthetic
  misc_feature: further information regarding the absence or presence of some residues is described in the specification
VPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYGVPGYG

SEQ ID NO: 98 - protein, 15000 aa, Artificial Sequence
  Synthetic
  misc_feature: further information regarding the absence or presence of some residues is described in the specification
VPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYGVPGVGVPGVGVPGVGVPGVGVPGVGVPGVGVPGVGVPGVGVPGVGVPGVGVPGYGVPGYGVPGYGVPGYGVPGYG

SEQ ID NO: 99 - protein, 11000 aa, Artificial Sequence
  Synthetic
  misc_feature: further information regarding the absence or presence of some residues is described in the specification
VPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYGVPGVGVPGVGVPGVGVPGVGVPGVGVPGVGVPGVGVPGVGVPGVGVPGVGVPGYG

SEQ ID NO: 100 - protein, 6000 aa, Artificial Sequence
  Synthetic
  misc_feature: further information regarding the absence or presence of some residues is described in the specification
VPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYGVPGVGVPGVGVPGVGVPGVGVPGVGVPGYG

SEQ ID NO: 101 - protein, 3000 aa, Artificial Sequence
  Synthetic
  misc_feature: further information regarding the absence or presence of some residues is described in the specification
VPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYG

SEQ ID NO: 102 - protein, 1500 aa, Artificial Sequence
  Synthetic
  misc_feature: further information regarding the absence or presence of some residues is described in the specification
VPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYG

SEQ ID NO: 103 - protein, 750 aa, Artificial Sequence
  Synthetic
  misc_feature: further information regarding the absence or presence of some residues is described in the specification
VPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYG

SEQ ID NO: 104 - protein, 225 aa, Artificial Sequence
  Synthetic
  misc_feature: further information regarding the absence or presence of some residues is described in the specification
VPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYGVPGVGVPGVGVPGYG

SEQ ID NO: 105 - protein, 187500 aa, Artificial Sequence
  Synthetic
  misc_feature: further information regarding the absence or presence of some residues is described in the specification
VPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGVGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCGVPGCG

SEQ ID NO: 106 - protein, 15000 aa, Artificial Sequence
  Synthetic
  misc_feature: further information regarding the absence or presence of some residues is described in the specification
VPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCGVPGVGVPGVGVPGVGVPGVGVPGVGVPGVGVPGVGVPGVGVPGVGVPGVGVPGCGVPGCGVPGCGVPGCGVPGCG

SEQ ID NO: 107 - protein, 11000 aa, Artificial Sequence
  Synthetic
  misc_feature: further information regarding the absence or presence of some residues is described in the specification
VPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCGVPGVGVPGVGVPGVGVPGVGVPGVGVPGVGVPGVGVPGVGVPGVGVPGVGVPGCG

SEQ ID NO: 108 - protein, 6000 aa, Artificial Sequence
  Synthetic
  misc_feature: further information regarding the absence or presence of some residues is described in the specification
VPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCGVPGVGVPGVGVPGVGVPGVGVPGVGVPGCG

SEQ ID NO: 109 - protein, 3000 aa, Artificial Sequence
  Synthetic
  misc_feature: further information regarding the absence or presence of some residues is described in the specification
VPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCG

SEQ ID NO: 110 - protein, 1500 aa, Artificial Sequence
  Synthetic
  misc_feature: further information regarding the absence or presence of some residues is described in the specification
VPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCG

SEQ ID NO: 111 - protein, 750 aa, Artificial Sequence
  Synthetic
  misc_feature: further information regarding the absence or presence of some residues is described in the specification
VPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCG

SEQ ID NO: 112 - protein, 225 aa, Artificial Sequence
  Synthetic
  misc_feature: further information regarding the absence or presence of some residues is described in the specification
VPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCGVPGVGVPGVGVPGCG

SEQ ID NO: 113 - protein, 10 aa, Artificial Sequence
  Synthetic
  misc_feature: Further description regarding the repeating sequence variables of the formula can be found in the specification
  misc_feature (4)..(4): Xaa is Glu, Asp, Arg, Val, Lys, His, Ser, Thr, Asn or Gln or is a mixture thereof
  misc_feature (9)..(9): Xaa is Tyr, Cys, Phe, Ile, Leu, Met; Val or Trp or is a mixture thereof
VPGXGVPGXG

SEQ ID NO: 114 - protein, 10 aa, Artificial Sequence
  Synthetic
  misc_feature: Further description regarding the repeating sequence variables of the formula can be found in the specification
  misc_feature: may contain GFP (green fluorescent protein), mEGFP (monomeric enhanced GFP), EYFP (enhanced yellow fluorescent protein), ECFP (enhanced cyan fluorescent protein) or any further suitable fluorescent proteins or derivative thereof at 5 and 3 end
  misc_feature (4)..(4): Xaa is Glu, Asp, Arg, Val, Lys, His, Ser, Thr, Asn or Gln, or is a non-naturally occurring amino acid, or is a mixture thereof
  misc_feature (5)..(6): in between these residues may contain GFP (green fluorescent protein), mEGFP (monomeric enhanced GFP), EYFP (enhanced yellow fluorescent protein), ECFP (enhanced cyan fluorescent protein) or any further suitable fluorescent proteins or derivative thereof
  misc_feature (9)..(9): Xaa is Tyr, Cys, Phe, Ile, Leu, Met, Val or Trp, or is a non-naturally occurring amino acid, or is a mixture thereof
VPGXGVPGXG

SEQ ID NO: 115 - protein, 10 aa, Artificial Sequence
  Synthetic
  misc_feature: Further description regarding the repeating sequence variables of the formula can be found in the specification
  misc_feature (4)..(4): Xaa is Glu, Asp, Arg, Lys (His, Ser, Thr, Asn, Gln
  misc_feature (9)..(9): Xaa is Phe, Ile, Leu, Val (Tyr, Trp, Met) or a mixture thereof
VPGXGVPGXG

SEQ ID NO: 116 - protein, 10 aa, Artificial Sequence
  Synthetic
  misc_feature: Further description regarding the repeating sequence variables of the formula can be found in the specification
  misc_feature (4)..(4): Xaa is Glu, Asp, Arg, Lys (His, Ser, Thr, Asn, Gln
  misc_feature (9)..(9): Xaa is Phe, Ile, Leu, Val (Tyr, Trp, Met) or a mixture thereof
VPGXGVPGXG

SEQ ID NO: 117 - protein, 10 aa, Artificial Sequence
  Synthetic
  misc_feature: Further description regarding the repeating sequence variables of the formula can be found in the specification
  misc_feature (4)..(4): Xaa is Glu, Asp, Arg, Lys (His, Ser, Thr, Asn, Gln
  misc_feature (9)..(9): Xaa is Phe, Ile, Leu, Val (Tyr, Trp, Met) or a mixture thereof
VPGXGVPGXG

SEQ ID NO: 118 - protein, 10 aa, Artificial Sequence
  Synthetic
  misc_feature: Further description regarding the repeating sequence variables of the formula can be found in the specification
  misc_feature (4)..(4): Xaa is Glu, Asp, Arg, Lys (His, Ser, Thr, Asn, Gln
  misc_feature (9)..(9): Xaa is Phe, Ile, Leu, Val (Tyr, Trp, Met) or a mixture thereof
VPGXGVPGXG

SEQ ID NO: 119 - protein, 10 aa, Artificial Sequence
  Synthetic
  misc_feature: Further description regarding the repeating sequence variables of the formula can be found in the specification
  misc_feature (4)..(4): Xaa is Glu, Asp, Arg, Lys (His, Ser, Thr, Asn, Gln
  misc_feature (9)..(9): Xaa is Phe, Ile, Leu, Val (Tyr, Trp, Met) or a mixture thereof
VPGXGVPGXG

SEQ ID NO: 120 - protein, 10 aa, Artificial Sequence
  Synthetic
  misc_feature: Further description regarding the repeating sequence variables of the formula can be found in the specification
  misc_feature (4)..(4): Xaa is Glu, Asp, Arg, Lys (His, Ser, Thr, Asn, Gln
  misc_feature (9)..(9): Xaa is Phe, Ile, Leu, Val (Tyr, Trp, Met) or a mixture thereof
VPGXGVPGXG

SEQ ID NO: 121 - protein, 10 aa, Artificial Sequence
  Synthetic
  misc_feature: Further description regarding the repeating sequence variables of the formula can be found in the specification
  misc_feature: may contain GFP (green fluorescent protein), mEGFP (monomeric enhanced GFP), EYFP (enhanced yellow fluorescent protein), ECFP (enhanced cyan fluorescent protein) or any further suitable fluorescent proteins or derivative thereof at 5 and 3 end
  misc_feature (4)..(4): Xaa is Glu, Asp, Arg, (Lys, Asn, Gln, Ser, Thr, His) or is a mixture thereof
  misc_feature (5)..(6): in between these residues may contain GFP (green fluorescent protein), mEGFP (monomeric enhanced GFP), EYFP (enhanced yellow fluorescent protein), ECFP (enhanced cyan fluorescent protein) or any further suitable fluorescent proteins or derivative thereof
  misc_feature (9)..(9): Xaa is is Phe, Ile, Leu, (Tyr, Trp, Meth, Val) or is a mixture thereof
VPGXGVPGXG

SEQ ID NO: 122 - protein, 10 aa, Artificial Sequence
  Synthetic
  misc_feature: Further description regarding the repeating sequence variables of the formula can be found in the specification
  misc_feature: may contain GFP (green fluorescent protein), mEGFP (monomeric enhanced GFP), EYFP (enhanced yellow fluorescent protein), ECFP (enhanced cyan fluorescent protein) or any further suitable fluorescent proteins or derivative thereof at 5 and 3 end
  misc_feature (4)..(4): Xaa is Glu, Asp, Arg, (Lys, Asn, Gln, Ser, Thr, His) or is a mixture thereof
  misc_feature (5)..(6): in between these residues may contain GFP (green fluorescent protein), mEGFP (monomeric enhanced GFP), EYFP (enhanced yellow fluorescent protein), ECFP (enhanced cyan fluorescent protein) or any further suitable fluorescent proteins or derivative thereof
  misc_feature (9)..(9): Xaa is is Phe, Ile, Leu, (Tyr, Trp, Meth, Val) or is a mixture thereof
VPGXGVPGXG

SEQ ID NO: 123 - protein, 10 aa, Artificial Sequence
  Synthetic
  misc_feature: Further description regarding the repeating sequence variables of the formula can be found in the specification
  misc_feature: may contain GFP (green fluorescent protein), mEGFP (monomeric enhanced GFP), EYFP (enhanced yellow fluorescent protein), ECFP (enhanced cyan fluorescent protein) or any further suitable fluorescent proteins or derivative thereof at 5 and 3 end
  misc_feature (4)..(4): Xaa is Glu, Asp, Arg, (Lys, Asn, Gln, Ser, Thr, His) or is a mixture thereof
  misc_feature (5)..(6): in between these residues may contain GFP (green fluorescent protein), mEGFP (monomeric enhanced GFP), EYFP (enhanced yellow fluorescent protein), ECFP (enhanced cyan fluorescent protein) or any further suitable fluorescent proteins or derivative thereof
  misc_feature (9)..(9): Xaa is is Phe, Ile, Leu, (Tyr, Trp, Meth, Val) or is a mixture thereof
VPGXGVPGXG

SEQ ID NO: 124 - protein, 10 aa, Artificial Sequence
  Synthetic
  misc_feature: Further description regarding the repeating sequence variables of the formula can be found in the specification
  misc_feature: may contain GFP (green fluorescent protein), mEGFP (monomeric enhanced GFP), EYFP (enhanced yellow fluorescent protein), ECFP (enhanced cyan fluorescent protein) or any further suitable fluorescent proteins or derivative thereof at 5 and 3 end
  misc_feature (4)..(4): Xaa is Glu, Asp, Arg, (Lys, Asn, Gln, Ser, Thr, His) or is a mixture thereof
  misc_feature (5)..(6): in between these residues may contain GFP (green fluorescent protein), mEGFP (monomeric enhanced GFP), EYFP (enhanced yellow fluorescent protein), ECFP (enhanced cyan fluorescent protein) or any further suitable fluorescent proteins or derivative thereof
  misc_feature (9)..(9): Xaa is is Phe, Ile, Leu, (Tyr, Trp, Meth, Val) or is a mixture thereof
VPGXGVPGXG

SEQ ID NO: 125 - protein, 10 aa, Artificial Sequence
  Synthetic
  misc_feature: Further description regarding the repeating sequence variables of the formula can be found in the specification
  misc_feature: may contain GFP (green fluorescent protein), mEGFP (monomeric enhanced GFP), EYFP (enhanced yellow fluorescent protein), ECFP (enhanced cyan fluorescent protein) or any further suitable fluorescent proteins or derivative thereof at 5 and 3 end
  misc_feature (4)..(4): Xaa is Glu, Asp, Arg, (Lys, Asn, Gln, Ser, Thr, His) or is a mixture thereof
  misc_feature (5)..(6): in between these residues may contain GFP (green fluorescent protein), mEGFP (monomeric enhanced GFP), EYFP (enhanced yellow fluorescent protein), ECFP (enhanced cyan fluorescent protein) or any further suitable fluorescent proteins or derivative thereof
  misc_feature (9)..(9): Xaa is is Phe, Ile, Leu, (Tyr, Trp, Meth, Val) or is a mixture thereof
VPGXGVPGXG

SEQ ID NO: 126 - protein, 10 aa, Artificial Sequence
  Synthetic
  misc_feature: Further description regarding the repeating sequence variables of the formula can be found in the specification
  misc_feature: may contain GFP (green fluorescent protein), mEGFP (monomeric enhanced GFP), EYFP (enhanced yellow fluorescent protein), ECFP (enhanced cyan fluorescent protein) or any further suitable fluorescent proteins or derivative thereof at 5 and 3 end
  misc_feature (4)..(4): Xaa is Glu, Asp, Arg, (Lys, Asn, Gln, Ser, Thr, His) or is a mixture thereof
  misc_feature (5)..(6): in between these residues may contain GFP (green fluorescent protein), mEGFP (monomeric enhanced GFP), EYFP (enhanced yellow fluorescent protein), ECFP (enhanced cyan fluorescent protein) or any further suitable fluorescent proteins or derivative thereof
  misc_feature (9)..(9): Xaa is is Phe, Ile, Leu, (Tyr, Trp, Meth, Val) or is a mixture thereof
VPGXGVPGXG

SEQ ID NO: 127 - protein, 5 aa, Artificial Sequence
  Synthetic
VPGCG

SEQ ID NO: 128 - protein, 360 aa, Artificial Sequence
  Synthetic
MVHPSSSGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGCGGNSEPRGDTYRAYNGGRGILEHHHHHH

SEQ ID NO: 129 - protein, 14 aa, Artificial Sequence
  Synthetic
  misc_feature: Further description regarding the repeating sequence variables of the formula can be found in the specification
  misc_feature (2)..(2): Xaa, if present, can be Ala or Gly
  misc_feature (4)..(4): Xaa, if present, can be Ala or Gly
  misc_feature (6)..(6): Xaa is Glu, Asp, Arg, Val, Lys, His, Ser, Thr, Asn or Gln or is a mixture thereof
  misc_feature (9)..(9): Xaa, if present, can be Ala or Gly
  misc_feature (11)..(11): Xaa, if present, can be Ala or Gly
  misc_feature (13)..(13): Xaa is Glu, Asp, Arg, Val, Lys, His, Ser, Thr, Asn or Gln or is a mixture thereof
VXPXGXGVXPXGXG

The invention claimed is:

1. Method for assembling multimeric protein or peptide structures, the method comprising the following steps:
   a) Providing or preparing a circular expression vector having a first unique restriction site for a first type II S restriction enzyme and a second unique restriction site for a second type II S restriction enzyme, the first type II S restriction enzyme suitable to generate a 3 base pair 5'-overhang in the lower strand of the vector upon cleavage with the first type II S restriction enzyme, and the second type II S restriction enzyme suitable to generate a 3 base pair 5'-overhang in the upper strand of the vector upon cleavage with the second type II S restriction enzyme, wherein the 3 base pair 5'-overhang in the upper strand and the 3 base pair 5'-overhang in the lower strand of the resulting insert and of the vector are complementary to each other; the circular expression vector also having a third unique restriction site for a third restriction enzyme, located upstream to or overlapping with the recognition sequence and/or restriction site of the first unique restriction enzyme, the third unique restriction site being different to the first and the second unique restriction site, wherein upon cleavage with the third restriction enzyme an at least 3 or 4 base pair 5'-overhang or an at least 3 or 4 base pair 3'-overhang is generated in the upper or lower strand of the vector different from the 5'-overhang generated by the first type II S restriction enzyme and the second type II S restriction enzyme;
   b) Digesting the circular expression vector with the first type II S restriction enzyme and the second type II S restriction enzyme to create a 3 base pair 5'-overhang in the lower strand and a 3 base pair 5'-overhang in the upper strand of the vector, wherein the 3 base pair 5'-overhang in the lower strand and the 3 base pair 5'-overhang in the upper strand are complementary to each other and complementary to the 3 base pair 5'-overhang in the upper strand of the resulting insert and the 3 base pair 5'-overhang in the lower strand of the insert;
   c) Inserting into the digested expression vector a multiple number of the same or different double stranded nucleic acid sequences encoding a protein or peptide sequence and exhibiting a complementary 3 base pair 5'-overhang in the upper strand and a complementary 3 base pair 5'-overhang in the lower strand;
   d) Circular ligation of the multiple number of double stranded nucleic acid sequences into the expression vector using a ligase;
   e) Optionally propagating the circular expression vector obtained according to step d);
   f) Optionally sequencing the circular expression vector obtained according to step d) or e);
   g) Selection of circular expression vectors obtained according to step d), e) and/or f), comprising a predetermined repeat number of double stranded nucleic acid sequences of at least 2 to 15;
   h) Digesting the circular expression vector selected according to step g) with the first Type II S restriction enzyme;
   i) Inserting into the digested expression vector a further double stranded nucleic acid sequence encoding a protein or peptide sequence and exhibiting a complementary 3 base pair 5'-overhang in the upper strand and a complementary 3 base pair 5'-overhang in the lower strand, wherein the further double stranded nucleic acid sequence may be identical or different to the double stranded nucleic acid sequence of step c);
   j) Circular ligation of the further double stranded nucleic acid sequence of step i) into the expression vector using a ligase;
   k) Repeating steps h) to j) at least once;
   l) Digesting the circular expression vector with the first type II S restriction enzyme and then subsequently with a type II or type II S restriction enzyme recognizing the third unique restriction site and cutting within the first unique type II S recognition sequence, inserting an insert into said digested expression vector, wherein the insert has been prepared by digesting the circular expression vector with the third unique restriction enzyme first and then subsequently with the second unique type II S restriction enzyme and then ligating the digested expression vector and the insert;

m) Optionally expressing, isolating and/or purifying the encoded multimeric protein or peptide structure.

2. Method according to claim 1, wherein the double stranded nucleic acid sequence is selected from
n) a nucleic acid sequence encoding an ELP-like protein sequence according to the following general formula (I):

$$[(VZ_1PZ_2GX_1G)_n(VZ_3PZ_4GX_2G)_m]_p \quad \text{(SEQ ID NO: 95)}$$

wherein:
V is Val
P is Pro;
G is Gly;
$X_1$ is Glu, Asp, Arg, Val, Lys, His, Ser, Thr, Asn or Gln, or is a mixture thereof;
$X_2$ is Tyr, Cys, Phe, Ile, Leu, Met, or Trp, or is a mixture thereof;
$Z_{1-4}$ is present or is not present and is independently from each other selected from Ala or Gly;
$n+m \geq 1$
n is an integer selected from 1 to 300;
m is an integer selected from 1 to 300;
p is an integer selected from 1 to 300;

o) a nucleic acid sequence encoding a resilintype ELP-like protein sequence according to the following general formula (Ia):

$$[(VPGVG)_n(VPGX_2G)_m]_p \quad \text{(SEQ ID NO: 96)}$$

wherein:
V is Val
P is Pro;
G is Gly;
$X_2$ is Tyr, Cys or Trp;
$n+m \geq 1$
n is an integer selected from 1 to 300;
m is an integer selected from 1 to 300;
p is an integer selected from 1 to 300; and/or p) a nucleic acid sequence encoding an amphiphilic ELP-like protein sequence according to the following general formula (Ib):

$$[(VZ_1PZ_2GX_1G)_n(VZ_3PZ_4GX_1G)_m]_p \quad \text{(SEQ ID NO: 129)}$$

or according to following general formula (Ic):

$$[(VPGX_1G)_n(VPGX_2G)_m]_p \quad \text{(SEQ ID NO: 113)}$$

or according to following general formula (Id):

$$[Y_q(VPGX_1G)_nY_q(VPGX_2G)_mY_q]_p \quad \text{(SEQ ID NO:114)}$$

wherein (in Ib or Ic or Id):
V is Val
P is Pro;
G is Gly;
$X_1$ is Glu, Asp, Arg, Val, Lys, His, Ser, Thr, Asn or Gln or is a mixture thereof;
$X_2$ is Tyr, Cys, Phe, Ile, Leu, Met; or Trp or is a mixture thereof,
Y is GFP (green fluorescent protein), mEGFP (monomeric enhanced GFP), EYFP (enhanced yellow FP), ECFP (C=cyan) or a derivative thereof;
$Z_{1-4}$ is present or is not present and is independently from each other selected from Ala or Gly;
$n+m \geq 1$
n is an integer selected from 1 to 300;
m is an integer selected from 1 to 300;
p is an integer selected from 1 to 300;
q is an integer of 0 and 1.

3. Method according to claim 1, wherein the double stranded nucleic acid sequence is additionally selected from
n) a nucleic acid sequence consisting of a nucleic acid sequence selected from any of SEQ ID NOs: 1, 3, 5, 7, 9, 11, 13, 15, 17, 19, 21, 23, 25, 27, 29, 31, 33, 35, 37, 39, 41, 90 or 91, or a nucleic acid comprising an identity of at least about 95% to one of the afore mentioned nucleic acid sequences; or o) a nucleic acid sequence consisting of a nucleic acid sequence encoding a protein sequence according to any of SEQ ID NOs: 2, 4, 6, 8, 10, 12, 14, 16, 18, 20, 22, 24, 26, 28, 30, 32, 34, 36, 38, 40, 42 to 77 or 80 to 89, or a protein comprising an identity of at least about 95% to one of the afore mentioned protein sequences.

4. Method according to claim 1, wherein the double stranded nucleic acid sequence encodes 1 protein or a consecutive number of 2 to 100 proteins, and wherein the double stranded nucleic acid sequence is selected from
n) a nucleic acid sequence encoding an ELP-like protein sequence according to the following general formula (I):

$$[(VZ_1PZ_2GX_1G)_n(VZ_3PZ_4GX_2G)_m]_p \quad \text{(SEQ ID NO: 95)}$$

wherein:
V is Val
P is Pro;
G is Gly;
$X_1$ is Glu, Asp, Arg, Val, Lys, His, Ser, Thr, Asn or Gln, or is a mixture thereof;
$X_2$ is Tyr, Cys, Phe, Ile, Leu, Met, or Trp, or is a mixture thereof;
$Z_{1-4}$ is present or is not present and is independently from each other selected from Ala or Gly;
$n+m \geq 1$
n is an integer selected from 1 to 300;
m is an integer selected from 1 to 300;
p is an integer selected from 1 to 300;

o) a nucleic acid sequence encoding a resilintype ELP-like protein sequence according to the following general formula (Ia):

$$[(VPGVG)_n(VPGX_2G)_m]_p \quad \text{(SEQ ID NO: 96)}$$

wherein:
V is Val
P is Pro;
G is Gly;
$X_2$ is Tyr, Cys or Trp;
$n+m \geq 1$
n is an integer selected from 1 to 300;
m is an integer selected from 1 to 300;
p is an integer selected from 1 to 300;

p) a nucleic acid sequence encoding an amphiphilic ELP-like protein sequence according to the following general formula (Ib):

$$[(VZ_1PZ_2GX_1G)_n(VZ_3PZ_4GX_2G)_m]_p \quad \text{(SEQ ID NO: 129)}$$

or according to following general formula (Ic):

$$[(VPGX_1G)_n(VPGX_2G)_m]_p \quad \text{(SEQ ID NO: 113)}$$

or according to following general formula (Id):

[Yq(VPGX$_1$G)$_n$Y$_q$(VPGX$_2$G)$_m$Yq]$_1$ (SEQ ID NO: 114)

wherein (in Ib or Ic or Id):
V is Val
P is Pro;
G is Gly;
X$_1$ is Glu, Asp, Arg, Val, Lys, His, Ser, Thr, Asn or Gln or is a mixture thereof;
X$_2$ is Tyr, Cys, Phe, Ile, Leu, Met; or Trp or is a mixture thereof,
Y is GFP (green fluorescent protein), mEGFP (monomeric enhanced GFP), EYFP (enhanced yellow FP), ECFP (C=cyan) or a derivative thereof;
Z$_{1-4}$ is present or is not present and is independently from each other selected from Ala or Gly;
n+m≥1
n is an integer selected from 1 to 300;
m is an integer selected from 1 to 300;
p is an integer selected from 1 to 300;
q is an integer of 0 and 1;
q) a nucleic acid sequence consisting of a nucleic acid sequence selected from any of SEQ ID NOs: 1, 3, 5, 7, 9, 11, 13, 15, 17, 19, 21, 23, 25, 27, 29, 31, 33, 35, 37, 39, 41, 90 or 91, or a nucleic acid comprising an identity of at least about 95% to one of the afore mentioned nucleic acid sequences; or
r) a nucleic acid sequence consisting of a nucleic acid sequence encoding a protein sequence according to any of SEQ ID NOs: 2, 4, 6, 8, 10, 12, 14, 16, 18, 20, 22, 24, 26, 28, 30, 32, 34, 36, 38, 40, 42 to 77 or 80 to 89, or a protein comprising an identity of at least about 95% to one of the afore mentioned protein sequences.

5. Method according to claim 1, wherein in step i) a double stranded nucleic acid is provided encoding a protein, and wherein the double stranded nucleic acid sequence is selected from
n) a nucleic acid sequence encoding an ELP-like protein sequence according to the following general formula (I):

[(VZ$_1$PZ$_2$GX$_1$G)$_n$(VZ$_3$PZ$_4$GX$_2$G)$_m$]$_p$ (SEQ ID NO: 95)

wherein:
V is Val
P is Pro;
G is Gly;
X$_1$ is Glu, Asp, Arg, Val, Lys, His, Ser, Thr, Asn or Gln, or is a mixture thereof;
X$_2$ is Tyr, Cys, Phe, Ile, Leu, Met, or Trp, or is a mixture thereof;
Z$_{1-4}$ is present or is not present and is independently from each other selected from Ala or Gly;
n+m≥1
n is an integer selected from 1 to 300;
m is an integer selected from 1 to 300;
p is an integer selected from 1 to 300;
o) a nucleic acid sequence encoding a resilintype ELP-like protein sequence according to the following general formula (Ia):

[(VPGVG)$_n$(VPGX$_2$G)$_m$]$_p$ (SEQ ID NO: 96)

wherein:
V is Val
P is Pro;
G is Gly;
X$_2$ is Tyr, Cys or Trp;
n+m≥1 n is an integer selected from 1 to 300;
m is an integer selected from 1 to 300;
p is an integer selected from 1 to 300;
p) a nucleic acid sequence encoding an amphiphilic ELP-like protein sequence according to the following general formula (Ib):

[(VZ$_1$PZ$_2$GX$_1$G)$_n$(VZ$_3$PZ$_4$GX$_1$G)$_m$]$_p$ (SEQ ID NO: 129)

or according to following general formula (Ic):

[(VPGX$_1$G)$_n$(VPGX$_2$G)$_m$]$_p$ (SEQ ID NO: 113)

or according to following general formula (Id):

[Yq(VPGX$_1$G)$_n$Y$_q$(VPGX$_2$G)$_m$Yq]$_p$ (SEQ ID NO: 114)

wherein (in Ib or Ic or Id):
V is Val
P is Pro;
G is Gly;
X$_1$ is Glu, Asp, Arg, Val, Lys, His, Ser, Thr, Asn or Gln or is a mixture thereof;
X$_2$ is Tyr, Cys, Phe, Ile, Leu, Met; or Trp or is a mixture thereof,
Y is GFP (green fluorescent protein), mEGFP (monomeric enhanced GFP), EYFP (enhanced yellow FP), ECFP (C=cyan) or a derivative thereof;
Z$_{1-4}$ is present or is not present and is independently from each other selected from Ala or Gly;
n+m≥1
n is an integer selected from 1 to 300;
m is an integer selected from 1 to 300;
p is an integer selected from 1 to 300;
q is an integer of 0 and 1;
q) a nucleic acid sequence consisting of a nucleic acid sequence selected from any of SEQ ID NOs: 1, 3, 5, 7, 9, 11, 13, 15, 17, 19, 21, 23, 25, 27, 29, 31, 33, 35, 37, 39, 41, 90 or 91, or a nucleic acid comprising an identity of at least about 95% to one of the afore mentioned nucleic acid sequences; or
r) a nucleic acid sequence consisting of a nucleic acid sequence encoding a protein sequence according to any of SEQ ID NOs: 2, 4, 6, 8, 10, 12, 14, 16, 18, 20, 22, 24, 26, 28, 30, 32, 34, 36, 38, 40, 42 to 77 or 80 to 89, or a protein comprising an identity of at least about 95% to one of the afore mentioned protein sequences;
in a subsequently following repetition of steps h) to j) a double stranded nucleic acid is provided encoding a cleavable protein sequence selected from a chemical cleavage site or a protease cleavage site or a hydroxyl amine cleavage site at one of its terminal ends, or alternatively in step i) a double stranded nucleic acid is provided encoding a protein, the protein being selected from one of n), o), p), q), or r), and additionally a protease cleavage site or a hydroxyl amine cleavage site at one of its terminal ends.

6. Method according to claim 5, wherein the cleavable protein sequences of a multimeric protein or peptide structure expressed isolated and/or purified according to final step l) are cleaved to obtain the monomeric proteins or peptides.

7. Multimeric protein or peptide structure consisting of a ELP-like protein sequence according to any of the following formulae (I), (Ia), (Ib), (Ic) or (Id), as defined in claim 2.

8. Multimeric protein or peptide structure according to claim 7, wherein the ELP-like protein sequence consists of a resilintype ELP-like protein sequence according to any of the following formulae:

| | |
|---|---|
| $[(VPGVG)_{1-25}(VPGYG)_{1-100}]_{3-300}$ | (SEQ ID NO: 97) |
| $[(VPGVG)_{1-10}(VPGYG)_{1-5}]_{3-200}$ | (SEQ ID NO: 98) |
| $[(VPGVG)_{1-10}(VPGYG)_{1}]_{3-200}$ | (SEQ ID NO: 99) |
| $[(VPGVG)_{1-5}(VPGYG)_{1}]_{3-200}$ | (SEQ ID NO: 100) |
| $[(VPGVG)_{2}(VPGYG)_{1}]_{3-200}$ | (SEQ ID NO: 101) |
| $[(VPGVG)_{2}(VPGYG)_{1}]_{10-100}$ | (SEQ ID NO: 102) |
| $[(VPGVG)_{2}(VPGYG)_{1}]_{10-50}$ | (SEQ ID NO: 103) |
| $[(VPGVG)_{2}(VPGYG)_{1}]_{15}$ | (SEQ ID NO: 104) |
| $[(VPGVG)_{1-25}(VPGCG)_{1-100}]_{3-300}$ | (SEQ ID NO: 105) |
| $[(VPGVG)_{1-10}(VPGCG)_{1-5}]_{3-200}$ | (SEQ ID NO: 106) |
| $[(VPGVG)_{1-10}(VPGCG)_{1}]_{3-200}$ | (SEQ ID NO: 107) |
| $[(VPGVG)_{1-5}(VPGCG)_{1}]_{3-200}$ | (SEQ ID NO: 108) |
| $[(VPGVG)_{2}(VPGCG)_{1}]_{3-200}$ | (SEQ ID NO: 109) |
| $[(VPGVG)_{2}(VPGCG)_{1}]_{10-100}$ | (SEQ ID NO: 110) |
| $[(VPGVG)_{2}(VPGCG)_{1}]_{10-50}$ | (SEQ ID NO: 111), or |
| $[(VPGVG)_{2}(VPGCG)_{1}]_{15}$ | (SEQ ID NO: 112). |

9. Multimeric protein or peptide structure according to claim 7, wherein the ELP-like protein sequence consists of an amphiphilic ELP-like protein sequence according to one of the following formulae:

| | |
|---|---|
| $[(VPGX_1G)_{1-300}(VPGX_2G)_{1-300}]_{1-300}$ | (SEQ ID NO: 115) |
| $[(VPGX_1G)_{1-200}(VPGX_2G)_{1-200}]_{1-200}$ | (SEQ ID NO: 116) |
| $[(VPGX_1G)_{1-100}(VPGX_2G)_{1-100}]_{1-100}$ | (SEQ ID NO: 117) |
| $[(VPGX_1G)_{2-100}(VPGX_2G)_{2-100}]_{1-50}$ | (SEQ ID NO: 118) |
| $[(VPGX_1G)_{5-100}(VPGX_2G)_{5-100}]_{1}$ | (SEQ ID NO: 119), or |
| $[(VPGX_1G)_{10-50}(VPGX_2G)_{10-50}]_{1}$ | (SEQ ID NO: 120) | wherein:
V is Val
P is Pro;
G is Gly;
$X_1$ is Glu, Asp, Arg, (Lys, Asn, Gln, Ser, Thr, His) or is a mixture thereof;
$X_2$ is Phe, Ile, Leu, (Tyr, Trp, Meth, Val) or is a mixture thereof.

10. Multimeric protein or peptide structure according to claim 7, wherein the ELP-like protein sequence consists of an amphiphilic ELP-like protein sequence according to one of the following formulae:

| | |
|---|---|
| $[Y_q(VPGX_1G)_{1-300}Y_q(VPGX_2G)_{1-300}Y_q]_{1-300}$ | (SEQ ID NO: 121) |
| $[Y_q(VPGX_1G)_{1-200}Y_q(VPGX_2G)_{1-200}Y_q]_{1-200}$ | (SEQ ID NO: 122) |
| $[Y_q(VPGX_1G)_{1-100}Y_q(VPGX_2G)_{1-100}Y_q]_{1-100}$ | (SEQ ID NO: 123) |
| $[Y_q(VPGX_1G)_{2-100}Y_q(VPGX_2G)_{2-100}Y_q]_{1-50}$ | (SEQ ID NO: 124) |
| $[Y_q(VPGX_1G)_{5-100}Y_q(VPGX_2G)_{5-100}Y_q]_{1}$ | (SEQ ID NO: 125), |
| $[Y_q(VPGX_1G)_{10-50}Y_q(VPGX_2G)_{10-50}Y_q]_{1}$ | (SEQ ID NO: 126) | wherein:
V is Val
P is Pro;
G is Gly;
$X_1$ is Glu, Asp, Arg, (Lys, Asn, Gln, Ser, Thr, His) or is a mixture thereof;
$X_2$ is Phe, Ile, Leu, (Tyr, Trp, Meth, Val) or is a mixture thereof, Y is GFP, EGFP, mEGFP, EYFP, ECFP or any derivative or mixture thereof of them; and
q is an integer of 0 or 1.

* * * * *